United States Patent 11,931,406 (FLAVIVIRUS VACCINE) - sequence listing, part 48

SEQ ID NO: 17685 - RNA, 9876 nt, Artificial Sequence
  derived and/or modified CDS sequence (opt4) from DENV-2__DQ645549__SS-prME
accgccggcgugaucaucaugaugauccccaccgugguggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcggcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugauggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggugaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgccaccgaggagaucgccgugaagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggaucgaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17686 - RNA, 9876 nt, Artificial Sequence
  derived and/or modified CDS sequence (opt4) from DENV-2__DQ645550__SS-prME
accgccggcgugaucaucaugaugauccccaccgugguggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcggcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagacuguggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugauggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggugaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgccaccgaggagaucgccgugaagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggaucgaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17687 - RNA, 9876 nt, Artificial Sequence
  derived and/or modified CDS sequence (opt4) from DENV-2__DQ645551__SS-prME
accgccggcgugaucaucaugaugauccccaccgugguggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacaccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcggcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugauggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgccaccgaggagaucgccgugaagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggaucgaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17688 - RNA, 9876 nt, Artificial Sequence
  derived and/or modified CDS sequence (opt4) from DENV-2__DQ645552__SS-prME
accgccggcgugaucaucaugaugauccccaccgugguggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcggcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugauggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccaccagcagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgccaccgaggagaucgccgugaagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggaucgaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17689 - RNA, 9876 nt, Artificial Sequence
  derived and/or modified CDS sequence (opt4) from DENV-2__DQ645553__SS-prME
accgccggcgugaucaucaugaugauccccaccgugguggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccccggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcggcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugauggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgccaccgaggagaucgccgugaagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcuggccguguggaacagaguguggauccaggagaaccccuggaucgaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17690 - RNA, 9876 nt, Artificial Sequence
  derived and/or modified CDS sequence (opt4) from DENV-2__DQ645554__SS-prME
accgccggcgugaucaucaugaugauccccaccgugguggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcggcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugauggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgccaccgaggagaucgccgugaagaacuggcuggccagagugggcagagagagacugagcagaauggccaucagcggcgacgacugcguggugaagccccuggacgacagauucgccagcgcccugaccgcccugaacgacaugggcaagaucagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggaucgaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17691 - RNA, 9876 nt, Artificial Sequence
  derived and/or modified CDS sequence (opt4) from DENV-2__DQ645555__SS-prME
accgccggcgugaucaucaugaugauccccaccgugguggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagccagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcggcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugauggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgccaccgaggagaucgccgugaagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggaucgaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17692 - RNA, 9876 nt, Artificial Sequence
  derived and/or modified CDS sequence (opt4) from DENV-2__DQ645556__SS-prME
accgccggcgugaucaucaugaugauccccaccgugguggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcggcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugauggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagaacauccagcagcugaccgccaccgaggagaucgccgugaagaacuggcuggccagagugggcagagagagacugagcagaauggccaucagcggcgacgacugcguggugaagccccuggacgacagauucgccagcgcccugaccgcccugaacgacaugggcaaggugagaaaggacgugcagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggaucgaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17693 - RNA, 9876 nt, Artificial Sequence
  derived and/or modified CDS sequence (opt4) from DENV-2__AF204178__SS-prME
accgccggcaugaucaucaugcugauccccaccgugauggccuuccaccugaccaccagaaacggcgagccccacaugaucgugagcagacaggagaagggcaagagccugcuguucaagaccggcgacggcgugaacaugugcacccugauggccauggaccccggcgagcugugcgaggacaccaucaccuacaagugcccccugcugaagcagaacgagcccgaggacaucgacugguggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaugauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgacagcagaugccccacccagggcgagcccagccugaacgaggagcaggacaagagauucgugugcaagcacagcaugguggacagaggcuggggcaacggcugcggccuguucggcaagggcggcaucgugaccuucgccauguucaccugcaagaagaacaugaagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccaugaagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacgacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgugaucaaggacaacagagccgcccacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagauggugagaaagauggagaaguaccagcuggccgugaccaucauggccauccugugcgugcccaacgccgugauccugcagaacgccuggaaggugagcugcaccauccuggccguggugagcgugagcccccuguucaucaccagcagccagcagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagauccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacgccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaaagcugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggagcagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccaagaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccuguuccugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagaucagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugggcaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccuguacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagagcauccagcaccugaccgugaccgaggagaucgccgugcagaacuggcuggccagagugagaagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17694 - RNA, 9876 nt, Artificial Sequence
  derived and/or modified CDS sequence (opt4) from DENV-2__AF204177__SS-prME
accgccggcaugaucaucaugcugauccccaccgugauggccuuccaccugaccaccagaaacggcgagccccacaugaucgugagcagacaggagaagggcaagagccugcuguucaagaccggcgacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggaccuggagcugaucaagaccgaggccaagcagagcgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacaugaagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacgaggugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgagugcugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagauggugagaaagauggagaaguaccagcuggccgugaccaucauggccauccugugcgugcccaacgccgugauccugcagaacgccuggaaggugagcugcaccauccuggccguggugagcgugagcccccuguuccugaccagcagccagcagaaggccgacuggaucccccuggcccugaccaucaagggccugaaccccaccgccaucuuccugaccacccugagcaagaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagauccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacgccggcggcuggaagcuggagggcgaguggaaggagggcgaggaggugcaggugcuggcccuggagcccggcaagaaccccagagccgugcagaccaagcccggccuguucaagaccaacgccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaaagcugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggagcagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccuguuccugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagagaggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagacccuguggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaagagaaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccagaacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagaccagcguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17695 - RNA, 9876 nt, Artificial Sequence
  derived and/or modified CDS sequence (opt4) from DENV-2__DQ645540__SS-prME
accgccggcgugaucaucaugaugauccccaccgugguggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaccaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcggcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugauggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggugaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgccaccgaggagaucgccgugaagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggaucgaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17696 - RNA, 9876 nt, Artificial Sequence
  derived and/or modified CDS sequence (opt4) from DENV-2__DQ645541__SS-prME
accgccggcgugaucaucaugaugauccccaccgugguggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaccaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcggcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugauggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgccaccgaggagaucgccgugaagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggaucgaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17697 - RNA, 9876 nt, Artificial Sequence
  derived and/or modified CDS sequence (opt4) from DENV-2__DQ645542__SS-prME
accgccggcgugaucaucaugaugauccccaccgugguggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaccaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcggcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugauggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgccaccgaggagaucgccgugaagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggaucgaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17698 - RNA, 9876 nt, Artificial Sequence
  derived and/or modified CDS sequence (opt4) from DENV-2__AY702036__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccaugcccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaacagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcagccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17699 - RNA, 9876 nt, Artificial Sequence
  derived and/or modified CDS sequence (opt4) from DENV-2__AY702034__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccaugcccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaacagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcagccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17700 - RNA, 9876 nt, Artificial Sequence
  derived and/or modified CDS sequence (opt4) from DENV-2__AF208496__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugccccuuccugagacagaacgagcccgaggacaucgacugcuggugcaacuucaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccaugcccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcagccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacaagagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17701 - RNA, 9876 nt, Artificial Sequence
  derived and/or modified CDS sequence (opt4) from DENV-2__AY702040__SS-prME
accgccggcaugaucaucaugcugauccccaccgugauggccuuccaccugaccaccagaaacggcgagccccacaugaucgugagcagacaggagaagggcaagagccugcuguucaagaccaaggacggcaccaacaugugcacccugauggccauggaccugggcgagcugugcgaggacaccaucaccuacaagugccccuuccugaagcagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccaucgcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgacagcagaugccccacccagggcgagcccacccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccguggugaucaccccccacagcggcgaggagcacgccgugggcaacgacaccggcaagcacggcaaggaggugaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcuggacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucgugaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucaccagcgagcugaaccacauccugagcgagaacgaggugaagcugaccaucaugaccggcgacaucaagggcaucaugcaggugggcaagagaagccugagaccccagcccaccgagcugagauacagcuggaagaccuggggcaaggccaagaugcugagcaccgagcugcacaaccagaccuuccugaucgacggccccgagaccgccgagugccccaacaccaacagagccuggaacagccuggagguggaggacuacggcuucggcguguucaccaccaacaucuggcugagacugagagagaagcaggacgccuucugcgaccccaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagauggugauccccaagaacuucgccggccccgugagccagcacaacaacagacccggcuaccacacccagaccgccggccccuggcaccugggcaagcuggagauggacuucgacuucugcgagggcaccaccgugguggugaccgaggagugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugagcagccuggugaccgccggccacggccagaucgacaacuucagccugggcauccugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcagcauccccgagaccauccuggagcugaccgacgcccuggcccugggcaugauggugcugaagauggugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggacgaccaggccgagaucagcggcagcagccccauccugagcaucaucaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcagagccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucagaaccaacaccggcaccaucggcgccgugagccuggacuucagccccggcaccagcggcagccccaucguggacaagaagggcaagguggugggccuguacggcaacggcguggugaccagaggcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaagaccggcaacgacaucgccgccugccugagaaagaacggcaagagagugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccagaaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaccagaaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcaaggccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacgugaucaucgccauccugaccgugguggccgccaccauggccaacgagaugggcuuccuggagaagaccaagaaggacuucggccugggccacaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccgugagcacccugugggagggcaaccccggcagauucuggaacaccaccaucgccgugagcauggccaacaucuucagaggcagcuaccuggccggcgccggccugcuguucagcaucaugaagaacaccaccagcgccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucgugccccccgagaagugcgacacccugcugugcgacaucggcgagagcagccccaaccccaccguggaggccggcagaacccugagagugcugaaccugguggagaacuggcugaacaacaacacccaguucugcgugaaggugcugaaccccuacaugcccagcgugaucgagagaauggagacccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacaacagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagaggugagcaagaaggagggcggcgccauguacgccgacgacaccgccggcugggacaccagaaucaccaucgaggaccugaagaacgaggagaugaucaccaaccacauggccggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgccagcgaggagaucgccgugcaggacuggcuggugagagugggcagagagagacugagcagaauggccaucagcggcgacgacugcguggugaagccccuggacgacagauucgccaaggcccugaccgcccugaacgacaugggcaaggugagaaaggacauccagcagugggagcccagcagaggcuggaacgacuggacccaggugcccuucugcagccaccacuuccacgagcugaucaugaaggacggcagaacccugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccagccacgaguggaugaccaccgaggacaugcugaccguguggaacagaguguggauccuggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17702 - RNA, 9876 nt, Artificial Sequence
  derived and/or modified CDS sequence (opt4) from DENV-2__AY037116__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcggcugccacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccgugacccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcuggugaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgccugggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgccagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacaucauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcaccugaccgugaccgaggagaucgccgugaagaacuggcuggugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17703 - RNA, 9876 nt, Artificial Sequence
  derived and/or modified CDS sequence (opt4) from DENV-2__AF169678__SS-prME
agcgccggcaugaucaucaugcugauccccaccgugauggccuuccaccugaccaccagaaacggcgagccccacaugaucgugagcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugauccugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcauccagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacaugaucacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugaagcacaagaaggccaccuacgagcccgacguggaccugggcagcggcaccagaaacaucggcaucgagagcgaggugcccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgccaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17704 - RNA, 9876 nt, Artificial Sequence
  derived and/or modified CDS sequence (opt4) from DENV-2__AF169679__SS-prME
agcgccggcaugaucaucaugcugauccccaccgugauggccuuccaccugaccaccagaaacggcgagccccacaugaucgugagcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccaagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugauccugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucagaaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacaugaucacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugaagcacaagaaggccaccuacgagcccgacguggaccugggcagcggcaccagaaacaucggcaucgagagcgaggugcccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgccaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17705 - RNA, 9876 nt, Artificial Sequence
  derived and/or modified CDS sequence (opt4) from DENV-2__AF169680__SS-prME
agcgccggcaugaucaucaugcugauccccaccgugauggccuuccaccugaccaccagaaacggcgagccccacaugaucgugagcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaucauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaacuuccugaucgacggccccgagaccgccgagugccccaacaccaacagagccuggaacagccuggagguggaggacuacggcuucggcguguucaccaccaacguguggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugauccugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggagagacaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaaagaugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucagaaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccagcguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacaccgugagcagaggcagcgccaagcugagaugguucguggagagaaacaugaucacccccgagggcaaggugcuggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugaagcacaagaaggccaccuacgagcccgacguggaccugggcagcggcaccagaaacaucggcaucgagagcgaggugcccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgccaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17706 - RNA, 9876 nt, Artificial Sequence
  derived and/or modified CDS sequence (opt4) from DENV-2__AF169682__SS-prME
agcgccggcaugaucaucaugcugauccccaccgugauggccuuccaccugaccaccagaaacggcgagccccacaugaucgugagcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcagaauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugauccugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccagccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccuggcccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccugguguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugaagcacaagaaggccaccuacgagcccgacguggaccugggcagcggcaccagaaacaucggcaucgagagcgaggugcccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgccaccgaggagaucgccgugcagaacugccuggccagacugggcagagagagacugagcagaauggccaucagcggcgacgacugcguggugaagccccuggacgacagauucgccagcgcccugaccgcccugaacgacaugggcaagaucagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17707 - RNA, 9876 nt, Artificial Sequence
  derived and/or modified CDS sequence (opt4) from DENV-2__AF169681__SS-prME
agcgccggcaugaucaucaugcugauccccaccgugauggccuuccaccugaccaccagaaacggcgagccccacaugaucgugagcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcagaauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccaagaccgccgagugccccaacaccaacagagccuggaacagccuggagguggaggacuacggcuucggcguguucaccaccaacaucuggcugaagcugaaggagaagcaggacgcccugugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugauccugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggagaaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccuggcccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccugguguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugagauacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgccaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaagaucagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17708 - RNA, 9876 nt, Artificial Sequence
  derived and/or modified CDS sequence (opt4) from DENV-2__AF169683__SS-prME
agcgccggcaugaucaucaugcugauccccaccgugauggccuuccaccugaccaccagaaacggcgagccccacaugaucgugagcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcagaauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcacgccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugauccugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacuucagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccuggcccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccugguguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgagagccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggcaucaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggccuggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgccaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaagaucagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17709 - RNA, 9876 nt, Artificial Sequence
  derived and/or modified CDS sequence (opt4) from DENV-2__AF169684__SS-prME
agcgccggcaugaucaucaugcugauccccaccgugauggccuuccaccugaccaccagaaacggcgagccccacaugaucgugagcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcagaauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugauccugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcagaagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagaaguaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacuucagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccuggcccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucuuccugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaagauacggcggcgcccuggugagaaacccccugagcagaaacagcacccacgagauguacugggugagcaacgccagcggcaacaucgugagcagcgugaacaugaucagcagaaugcugaucaacagauucaccaugaagcacaagaaggccaccuacgagcccgacguggaccugggcagcggcaccagaaacaucggcaucgagagcgaggugcccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgccaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaagaucagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17710 - RNA, 9876 nt, Artificial Sequence
  derived and/or modified CDS sequence (opt4) from DENV-2__AF169685__SS-prME
agcgccggcaugaucaucaugcugauccccaccgugauggccuuccaccugaccaccagaaacggcgagccccacaugaucgugagcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcagaauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugauccugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacuucagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccuggcccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccugguguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaagauacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgaggugcccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgccaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaagaucagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17711 - RNA, 9876 nt, Artificial Sequence
  derived and/or modified CDS sequence (opt4) from DENV-2__AF169686__SS-prME
agcgccggcaugaucaucaugcugauccccaccgugauggccuuccaccugaccaccagaaacggcgagccccacaugaucgugagcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcagaauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagaucuucaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugauccugaccagcagccagcagaagaccgacuggaucccccuggcccugaccaucaagggccugaaccccaccgccaucuuccugaccacccugagcagaaccaacaagaagagaagcuggcccgugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagaaguaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacuucagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccuggcccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccugguguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaagauacggcggcgcccuggugagaaacccccugagcagaaacagcacccacgagauguacugggugagcaacgccagcggcaacaucgugagcagcgugaacaugaucagcagaaugcugaucaacagauucaccaugaagcacaagaaggccaccuacgagcccgacguggaccugggcagcggcaccagaaacaucggcaucgagagcgaggugcccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgagacccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgccaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaagaucagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17712 - RNA, 9876 nt, Artificial Sequence
  derived and/or modified CDS sequence (opt4) from DENV-2__AF169687__SS-prME
agcgccggcaugaucaucaugcugauccccaccgugauggccuuccaccugaccaccagaaacggcgagccccacaugaucgugagcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcagaauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcacgccggcaagagaagccugagaccccagcccaccgagcugaaguacagcuggaagaccuggggcaucgccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugaccgugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugauccugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacuucagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccuggcccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccugguguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcagcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggcagccacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgccaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaagaucagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17713 - RNA, 9876 nt, Artificial Sequence
  derived and/or modified CDS sequence (opt4) from DENV-2__AF169688__SS-prME
agcgccggcaugaucaucaugcugauccccaccgugauggccuuccaccugaccaccagaaacggcgagccccacaugaucgugagcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaccagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcagaauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcacgccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugauccugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacuucagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccuggcccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccugguguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcaagacccugggcgagaaguggaagagcagacugaacgcccugggcaagaucgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgccaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaagaucagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17714 - RNA, 9873 nt, Artificial Sequence
  derived and/or modified CDS sequence (opt4) from DENV-3__AB189125__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagagcccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcugaucgagggcaagguggugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugcagcaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucaucaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcauccuggagcagggcaagagaacccugaccccccagcccauggagcugaaguacagcuggaagaccuggggcaaggccaagaucgugaccgccgagauccagaacagcagcuucaucaucgacggccccaacacccccgagugccccaacgccagcagagccuggaacgugugggagguggaggacuacggcuucggcguguucaccaccaacaucuggcugaagcugagagagauguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggccagaacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaugugcagcaacaccaucuucacccugaccguggccuggagaaccgccacccugauccuggccggcaucagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccagcugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcaaggagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgacuggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacguggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgugaugcuguuccugaucagcggcaagggcgugggcaagaccagcaucggccugaucugcgugguggccagcagcggcaugcuguggauggccgacaucccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccgccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugaccuacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccaccgugacccagauggccaugaccgacaccacccccuucggccagcagagaguguucaaggagaagguggacaccagaacccccaagcccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaagaccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaagccaggacgagcugaucggcagagccagaaucagccagggcgccggcuggagccugaaggagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 17715 - RNA, 9873 nt, Artificial Sequence
  derived and/or modified CDS sequence (opt4) from DENV-3__AB189126__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagagcccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcugaucgagggcaagguggugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugcagcaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucaucaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagguggugaccgccgagauccagaacagcagcuucaucaucgacggccccaacacccccgagugccccaacgccagcagagccuggaacgugugggagguggaggacuacggcuucggcguguucaccaccaacaucuggcugaagcugagagagauguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcauccuguucaucuucgugcugcugcugagcggccagaucaccuggagagacauggccagaacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaccugcagcaacaccaucuucacccugaccguggccuggagaaccgccacccugauccuggccggcaucagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcaaggagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgacuggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcgugggcaagaccagcaucggccugaucugcgugguggccagcagcggcaugcuguggauggccgacaucccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugccccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccaccgugacccagauggccaugaccgacaccacccccuucggccagcagagaguguucaaggagaagguggacaccagaacccccaagcccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaagaccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagcuggagggcgccaucugguga

SEQ ID NO: 17716 - RNA, 9873 nt, Artificial Sequence
  derived and/or modified CDS sequence (opt4) from DENV-3__AB189127__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagagcccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcugaucgagggcaagguggugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugcagcaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucaucaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagguggugaccgccgagauccagaacagcagcuucaucaucgacggccccaacacccccgagugccccaacgccagcagagccuggaacgugugggagguggaggacuacggcuucggcguguucaccaccaacaucuggcugaagcugagagagauguacacccagcugugcgaccacagacugaugagcgccgccgugaaggacgagagagccauccacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcauccuguucauguucgugcugcugcugagcggccagaucaccuggagagacauggccagaacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaccugcagcaacaccaucuucacccugaccguggccuggagaaccgccacccugauccuggccggcaucagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccagcugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcaaggagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgacuggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcgugggcaagaccagcaucggccugaucugcgugguggccagcagcggcaugcuguggauggccgacaucccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugccccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccaccgugacccagauggccaugaccgacaccacccccuucggccagcagagaguguucaaggagaagguggacaccagaacccccaagcccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaagaccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagcuggagggcgccaucugguga

SEQ ID NO: 17717 - RNA, 9873 nt, Artificial Sequence
  derived and/or modified CDS sequence (opt4) from DENV-3__AB189128__SS-prME
accagccugugccugaugaugauccugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggccuucagacaccccggcuucaccgugcuggcccuguuccuggcccacuucaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaagguggugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugccugaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaccggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccaccgagcugaaguacagcuggaagaccuggggcaaggccaagaucgugaccgccgagacccagaacagcagcuucaucaucgacggccccaacacccccgagugccccagcgccagcagagccuggaacgugugggagguggaggaguacggcuucggcguguucaccaccaacaucuggcugaagcugagagagauguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggccagaacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaugugcagcaacaccaucuucacccugaccguggccuggagaaccgccacccugauccuggccggcaucagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccaacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggacggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcaaggagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugguggccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaucagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcugauccugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccaccgugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcuggagaagaagaucacccaguggcuggaggccgagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccacaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 17718 - RNA, 9873 nt, Artificial Sequence
  derived and/or modified CDS sequence (opt4) from DENV-3__AB214879__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaagguggugcagcacgagaaccugaaguacaccgugaucaucaccgugcacaccggcgaccagcaccaggugggcaacgagacccagggcgugaccgccgagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcguguucgccggccaccugaagugcagacugaagauggacaagcuggagcugaagggcaugagcuacgccaugugcagcaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucaucaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagauguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggccagaacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaccagccugaugugcagcaacaccaucuucacccugaccguggccuggagaaccgccacccugauccuggccggcaucagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagagcggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcaaggagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgacuggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgccuucgaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugguggccagcagcggcaugcuguggauggccgacaucccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugaccuacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccaccgugacccagauggccaugaccgacaccacccccuucggccagcagagaguguucaaggagaagguggacaccagaacccccaagcccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaagaccgaccuggagaacccccaccugcuggagaagagaaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 17719 - RNA, 9873 nt, Artificial Sequence
  derived and/or modified CDS sequence (opt4) from DENV-3__AB214880__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaagguggugcagcacgagaaccugaaguacaccgugaucaucaccgugcacaccggcgaccagcaccaggugggcaacgagacccagggcgugaccgccgagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugcagcaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucaucaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagauguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggccagaacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggccagccugaugugcagcaacaccaucuucacccugaccguggccuggagaaccgccacccugauccuggccggcaucagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagagcggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcaaggagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgacuggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgccuucgaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugguggccagcagcggcaugcuguggauggccgacaucccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugaccuacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccaccgugacccagauggccaugaccgacaccacccccuucggccagcagagaguguucaaggagaagguggacaccagaacccccaagcccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaagaccgaccuggagaacccccaccugcuggagaagagaaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 17720 - RNA, 9873 nt, Artificial Sequence
  derived and/or modified CDS sequence (opt4) from DENV-3__AB214881__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaagguggugcagcacgagaaccugaaguacaccgugaucaucaccgugcacaccggcgaccagcaccaggugggcaacgagacccagggcgugaccgccgagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugcagcaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucaucaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcauccuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagauguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggccagaacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggccagccugaugugcagcaacaccaucuucacccugaccguggccuggagaaccgccacccugauccuggccggcaucagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagagcggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcaaggagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgacuggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgccuucgaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugguggccagcagcggcaugcuguggauggccgacaucccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugaccuacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccaccgugacccagauggccaugaccgacaccacccccuucggccagcagagaguguucaaggagaagguggacaccagaacccccaagcccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaagaccgaccuggagaacccccaccugcuggagaagagaaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagcuggagggcgccaucugguga

SEQ ID NO: 17721 - RNA, 9873 nt, Artificial Sequence
  derived and/or modified CDS sequence (opt4) from DENV-3__AB214882__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaagguggugcagcacgagaaccugaaguacaccgugaucaucaccgugcacaccggcgaccagcaccaggugggcaacgagacccagggcgugaccgccgagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugcagcaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucaucaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaccggcauccuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagauguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggccagaacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggccagccugaugugcagcaacaccaucuucacccugaccguggccuggagaaccgccacccugauccuggccggcaucagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagagcggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcaaggagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgacuggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgccuucgaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugguggccagcagcggcaugcuguggauggccgacaucccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugaccuacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccaccgugacccagauggccaugaccgacaccacccccuucggccagcagagaguguucaaggagaagguggacaccagaacccccaagcccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaagaccgaccuggagaacccccaccugcuggagaagagaaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 17722 - RNA, 9873 nt, Artificial Sequence
  derived and/or modified CDS sequence (opt4) from DENV-3__JX669489__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacagaggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagaucgccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17723 - RNA, 9873 nt, Artificial Sequence
  derived and/or modified CDS sequence (opt4) from DENV-3__JX669498__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagagcaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaccggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucggcaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17724 - RNA, 9873 nt, Artificial Sequence
  derived and/or modified CDS sequence (opt4) from DENV-3__KF954946__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccauccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcaucaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgugggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagaugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcaugcuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcauccugggcaagacccaggugggcgugggcgugcagaaggacggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugaccauggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugcugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaucaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccgccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccaaggccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacugcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcuggugagacagauggagggcgagggcgugcugagcaagaccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccauccccgugcacugggugcccaccagcagaaccaccuggagcauccacgcccaccaccaguggaugaccaccgaggacaugcugaccguguggaacagaguguggaucgaggacaaccccuggauggaggacaagacccccaucaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17725 - RNA, 9873 nt, Artificial Sequence
  derived and/or modified CDS sequence (opt4) from DENV-3__KF954947__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcaucaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgugggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagaugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcaugcuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcauccugggcaagacccaggugggcgugggcgugcagaaggacggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugaccauggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaucaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccgccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccaaggccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagagaauggaccccgagcacagacugcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcuggugagacagauggagggcgagggcgugcugagcaagaccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccauccccgugcacugggugcccaccagcagaaccaccuggagcauccacgcccaccaccaguggaugaccaccgaggacaugcugaccguguggaacagaguguggaucgaggacaaccccuggauggaggacaagacccccaucaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17726 - RNA, 9873 nt, Artificial Sequence
  derived and/or modified CDS sequence (opt4) from DENV-3__KF954945__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccauccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcaucaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgugggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagaugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcaugcuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcauccugggcaagacccaggugggcgugggcgugcagaaggacggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugaccauggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaucaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccgccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccaaggccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacugcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcuggugagacagauggagggcgagggcgugcugagcaagaccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccauccccgugcacugggugcccaccagcagaaccaccuggagcauccacgcccaccaccaguggaugaccaccgaggacaugcugaccguguggaacagaguguggaucgaggacaaccccuggauggaggacaagacccccaucaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17727 - RNA, 9873 nt, Artificial Sequence
  derived and/or modified CDS sequence (opt4) from DENV-3__JX669495__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaaggugacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17728 - RNA, 9873 nt, Artificial Sequence
  derived and/or modified CDS sequence (opt4) from DENV-3__JX669499__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcaucaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17729 - RNA, 9873 nt, Artificial Sequence
  derived and/or modified CDS sequence (opt4) from DENV-3__JX669492__SS-prME
accagcuucugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17730 - RNA, 9873 nt, Artificial Sequence
  derived and/or modified CDS sequence (opt4) from DENV-3__JX669500__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17731 - RNA, 9873 nt, Artificial Sequence
  derived and/or modified CDS sequence (opt4) from DENV-3__JX669497__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgccagcaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17732 - RNA, 9873 nt, Artificial Sequence
  derived and/or modified CDS sequence (opt4) from DENV-3__JX669501__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacagaggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcguggugaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaccaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccauggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugauguacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17733 - RNA, 9873 nt, Artificial Sequence
  derived and/or modified CDS sequence (opt4) from DENV-3__JX669494__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaccaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacagaggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacaccgugagcagacugcugcugaacagauucaccaugacccacagaagacccaccaccgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17734 - RNA, 9873 nt, Artificial Sequence
  derived and/or modified CDS sequence (opt4) from DENV-3__JX669503__SS-prME
accagcuucugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagaguggugcuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17735 - RNA, 9873 nt, Artificial Sequence
  derived and/or modified CDS sequence (opt4) from DENV-3__JX669493__SS-prME
accagcuucugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaucggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17736 - RNA, 9873 nt, Artificial Sequence
  derived and/or modified CDS sequence (opt4) from DENV-3__JX669504__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaccaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacagaggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucacccuggugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacaccgugagcagacugcugcugaacagauucaccaugacccacagaagacccaccaccgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17737 - RNA, 9873 nt, Artificial Sequence
  derived and/or modified CDS sequence (opt4) from DENV-3__JX669506__SS-prME
accagcuucugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggccuacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17738 - RNA, 9873 nt, Artificial Sequence
  derived and/or modified CDS sequence (opt4) from DENV-3__JX669496__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaccaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcgccaacaccuucgugcugaagaaggaggugagcgagacccagcacggcaccauccugaucaagguggaguacagaggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacaccgugagcagacugcugcugaacagauucaccaugacccacagaagacccaccaccgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17739 - RNA, 9873 nt, Artificial Sequence
  derived and/or modified CDS sequence (opt4) from DENV-3__JX669490__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacagaggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17740 - RNA, 9873 nt, Artificial Sequence
  derived and/or modified CDS sequence (opt4) from DENV-3__JN406515__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagagcccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcugaucgagggcaagguggugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugcagcaacgccuucgugcugaagaaggaggugagcgagacccagcacggcaccauccugaucaagguggaguacaagggcgaggacgcccccugcaagauccccuucagcaccgaggacgagcagggcaaggcccacaacggcagacugaucaccgccaaccccguggugaccaagaaggaggagcccgugaacaucgaggccgagccccccuucggcgagagcaacaucaucaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccaacgccagcagagccuggaacgugugggagguggaggacuacggcuucggcguguucaccaccaacaucuggcugaagcugagagagauguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggccagaacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacguggagcagauggccaacggcaucgcccugggccugauggcccugaagcugaucacccaguucgagaccuaccagcuguggaccgcccuggugagccugaugugcagcaacaccaucuucacccugaccguggccuggagaaccgccacccugauccuggccggcaucagccuguuccccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaugauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcaaggagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgacuggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcgugggcaagaccagcaucggccugaucugcgugguggccagcagcggcaugcuguggauggccgacaucccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugaccuacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccaccgugacccagauggccaugaccgacaccacccccuucggccagcagagaguguucaaggagaagguggacaccagaacccccaagcccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaagaccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaaggcccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 17741 - RNA, 9873 nt, Artificial Sequence
  derived and/or modified CDS sequence (opt4) from DENV-3__JN406514__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguuccuggaccugccccugcccuggaccagcggcgccaccaccgagagacccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucagcaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaucuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacaagcagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17742 - RNA, 9873 nt, Artificial Sequence
  derived and/or modified CDS sequence (opt4) from DENV-3__KT726340__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcgugaucaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugguggagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaaccccagacugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccaucaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17743 - RNA, 9873 nt, Artificial Sequence
  derived and/or modified CDS sequence (opt4) from DENV-3__KT726345__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaucugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17744 - RNA, 9873 nt, Artificial Sequence
  derived and/or modified CDS sequence (opt4) from DENV-3__KT726349__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagagcauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17745 - RNA, 9873 nt, Artificial Sequence
  derived and/or modified CDS sequence (opt4) from DENV-3__KT726347__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcuggccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17746 - RNA, 9873 nt, Artificial Sequence
  derived and/or modified CDS sequence (opt4) from DENV-3__KT726352__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccgccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17747 - RNA, 9873 nt, Artificial Sequence
  derived and/or modified CDS sequence (opt4) from DENV-3__KT726356__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugcuggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugaccuacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17748 - RNA, 9873 nt, Artificial Sequence
  derived and/or modified CDS sequence (opt4) from DENV-3__KT726342__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17749 - RNA, 9873 nt, Artificial Sequence
  derived and/or modified CDS sequence (opt4) from DENV-3__KT726343__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17750 - RNA, 9873 nt, Artificial Sequence
  derived and/or modified CDS sequence (opt4) from DENV-3__KT726351__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaaaggugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17751 - RNA, 9873 nt, Artificial Sequence
  derived and/or modified CDS sequence (opt4) from DENV-3__KT726360__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggaccccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17752 - RNA, 9873 nt, Artificial Sequence
  derived and/or modified CDS sequence (opt4) from DENV-3__KF041259__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaacgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagaugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcagacuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcauccugggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagagaaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaucaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccgccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaagaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccaaggccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacugcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagcuggagggcgccaucugguga

SEQ ID NO: 17753 - RNA, 9873 nt, Artificial Sequence
  derived and/or modified CDS sequence (opt4) from DENV-3__KF041258__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagaugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaugacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcauccugggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagagaaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaucaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccgccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccaaggccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacgugcugagagacaucagcaagauccccggcggcgccauguacgccgacgacaccgccggcugggacaccagaaucaccgaggacgaccugcacaacgaggagaagaucacccagcagauggaccccgagcacagacugcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagcuggagggcgccaucugguga

SEQ ID NO: 17754 - RNA, 9873 nt, Artificial Sequence
  derived and/or modified CDS sequence (opt4) from DENV-3__KF041257__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagaugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcauccugggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagagaaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaucaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugagagagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccgccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccaaggccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacugcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagcuggagggcgccaucugguga

SEQ ID NO: 17755 - RNA, 9873 nt, Artificial Sequence
  derived and/or modified CDS sequence (opt4) from DENV-3__KF041255__SS-prME
accagccugugccugaugaugauccugcccgccgcccuggccuuccaccugaccagcagaaacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagaugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcauccugggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagagaaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaucaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccgccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaagaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccaaggccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacugcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagcuggagggcgccaucugguga

SEQ ID NO: 17756 - RNA, 9873 nt, Artificial Sequence
  derived and/or modified CDS sequence (opt4) from DENV-3__KF041256__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagaugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcauccugggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccacccugaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagagaaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaucaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgagaagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccgccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaagaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccaaggccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacugcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccauccacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagcuggagggcgccaucugguga

SEQ ID NO: 17757 - RNA, 9873 nt, Artificial Sequence
  derived and/or modified CDS sequence (opt4) from DENV-3__KF041254__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgugguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggagaaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagauguacacccagaugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcauccugggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagagaaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccacccuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaucaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccagagccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccgccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcaagcugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccaaggccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacugcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagcuggagggcgccaucugguga

SEQ ID NO: 17758 - RNA, 9873 nt, Artificial Sequence
  derived and/or modified CDS sequence (opt4) from DENV-3__KX380841__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcaucaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagaugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcauccugggcaagacccaggugggcgugggcgugcagaaggacggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugaccauggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaucaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccgccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccaaggccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacugcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcuggugagacagauggagggcgagggcgugcugagcaagaccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccaucaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17759 - RNA, 9873 nt, Artificial Sequence
  derived and/or modified CDS sequence (opt4) from DENV-3__KX380842__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcaucaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgugggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagaugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcaugcuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcauccugggcaagacccaggugggcgugggcgugcagaaggacggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugaccauggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaucaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccgccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccaaggccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacugcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcuggugagacagauggagggcgagggcgugcugagcaagaccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccauccccgugcacugggugcccaccagcagaaccaccuggagcauccacgcccaccaccaguggaugaccaccgaggacaugcugaccguguggaacagaguguggaucgaggacaaccccuggauggaggacaagacccccaucaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17760 - RNA, 9873 nt, Artificial Sequence
  derived and/or modified CDS sequence (opt4) from DENV-3__KX380839__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccaucaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagagcccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcugaccgagggcaagguggugcagcacgagaaccugaaguacaccgugaucaucaccgugcacaccggcgaccagcaccaggugggcaacgagacccagggcgugaccgccgagaucaccccccaggccagcaccguggaggccaucuucagaagcuacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugcagcaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucaucaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcauccuggagcagggcaagagaacccugaccccccagcccauggagcugaaguacagcuggaagaccuggggcaaggccaagaucgugaccgccgagacccagaacagcagcuucaucaucgacggccccaacacccccgagugccccaacgccagcagagccuggaacgugugggagguggaggacuacggcuucggcguguucaccaccaacaucuggcugaagcugagagagauguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggccagaacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcugugggccgcccuggugagccugaugugcagcaacaccaucuucacccugaccguggccuggagaaccgccacccugauccuggccggcaucagccugcugcccaugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcaaggagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgacuggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccccccaccuggcccacagaaccagaaacgcccuggacaaccuggugaugcugcacaccagcgaguacggcggcagagccuacagacacgccguggaggagcugcccgagaccauggagacccugcugcugcugggccugaugauccugcugaccggcggcgugaugcuguuccugaucagcggcaagggcgugggcaagaccagcaucggccugaucugcgugguggccagcagcggcaugcuguggauggccgacaucccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaucagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccgccgugaucgagcaccuggagagacugcagagaaagcacggcggcaugcuggugagaaacccccugagcagaaacagcacccacgagauguacuggaucagcaacggcaccggcaacaucgugagcagcgugaacaugaucagcagacugcugcugaacagauucaccaugaccuacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccaccgugacccagauggccaugaccgacaccacccccuucggccagcagagaguguucaaggagaagguggacaccagaacccccaagcccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaagaccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 17761 - RNA, 9873 nt, Artificial Sequence
  derived and/or modified CDS sequence (opt4) from DENV-3__KX380840__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccaucaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagagcccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcugaccgagggcaagguggugcagcacgagaaccugaaguacaccgugaucaucaccgugcacaccggcgaccagcaccaggugggcaacgagacccagggcgugaccgccgagaucaccccccaggccagcaccguggaggccaucuucagaagcuacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugcagcaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucaucaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcauccuggagcagggcaagagaacccugaccccccagcccauggagcugaaguacagcuggaagaccuggggcaaggccaagaucgugaccgccgagacccagaacagcagcuucaucaucgacggccccaacacccccgagugccccaacgcccugagagccuggaacgugugggagguggaggacuacggcuucggcguguucaccaccaacaucuggcugaagcugagagagauguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggccagaacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcugugggccgcccuggugagccugaugugcagcaacaccaucuucacccugaccguggccuggagaaccgccacccugauccuggccggcaucagccugcugcccaugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcaaggagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgacuggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccccccaccuggcccacagaaccagaaacgcccuggacaaccuggugaugcugcacaccagcgaguacggcggcagagccuacagacacgccguggaggagcugcccgagaccauggagacccugcugcugcugggccugaugauccugcugaccggcggcgugaugcuguuccugaucagcggcaagggcgugggcaagaccagcaucggccugaucugcgugguggccagcagcggcaugcuguggauggccgacaucccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaucagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccgccgugaucgagcaccuggagagacugcagagaaagcacggcggcaugcuggugagaaacccccugagcagaaacagcacccacgagauguacuggaucagcaacggcaccggcaacaucgugagcagcgugaacaugaucagcagacugcugcugaacagauucaccaugaccuacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccaccgugacccagauggccaugaccgacaccacccccuucggccagcagagaguguucaaggagaagguggacaccagaacccccaagcccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaagaccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 17762 - RNA, 9873 nt, Artificial Sequence
  derived and/or modified CDS sequence (opt4) from DENV-3__JF808121__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaccaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcugaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucagcggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaccggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaccaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaucgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugaagcacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggaagacccugggcagaaacaagaagcccagacugugccccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcagcggcuggagccugagagagaccgccugccugggcaaggccuacgcccagauguggagccugauguacuuccacagaagagaccugagacuggccagcaacgccaucugcagcgccgugcccgugcacugggugcccaccagcagaaugaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17763 - RNA, 9873 nt, Artificial Sequence
  derived and/or modified CDS sequence (opt4) from DENV-3__JF808120__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcugaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaccggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcugaagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucaaccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcauccugggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucaucgaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugaccaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcagcggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17764 - RNA, 9873 nt, Artificial Sequence
  derived and/or modified CDS sequence (opt4) from DENV-3__JF808119__SS-prME
accagccugugccugaugaugauccugcccaccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggacgagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagguggccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucauguucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucaucaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaagauccugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgaggacugcgugcugaagcccaucgacgacagauucgacaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccugcaccaguggaugaccaccgaggacaugaucaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17765 - RNA, 9873 nt, Artificial Sequence
  derived and/or modified CDS sequence (opt4) from DENV-3__JF808118__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccauccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17766 - RNA, 9873 nt, Artificial Sequence
  derived and/or modified CDS sequence (opt4) from DENV-3__JF808127__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagccugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaccggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccgagcccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccugaacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaagauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccaagcugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17767 - RNA, 9873 nt, Artificial Sequence
  derived and/or modified CDS sequence (opt4) from DENV-3__JF808124__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcaccuucggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcuggugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagguggccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccugcgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagaugggcaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugauccugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucggcgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaucuacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugagcuggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17768 - RNA, 9873 nt, Artificial Sequence
  derived and/or modified CDS sequence (opt4) from DENV-3__JF808126__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucacccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguuccuggaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaagagcaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccgcccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcugcccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccuggugagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcagaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaagauggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcccuggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17769 - RNA, 9873 nt, Artificial Sequence
  derived and/or modified CDS sequence (opt4) from DENV-3__JF808125__SS-prME
accagccugugccugaugaugauccugcccgccgcccuggccuuccaccugaccagcagagacggcgagcccagaaugaucgugggcgagaacgagagaggcaagagccugcuguucaagaccgccagcggcaucaacagaagaacccugaucgccauggaccugggcgagaugugcgaggagaccgagaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccgccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcagcggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugagacugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17770 - RNA, 9873 nt, Artificial Sequence
  derived and/or modified CDS sequence (opt4) from DENV-3__JF808129__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaccggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacugcaccaugggcgugcugugccuggccauccuguucgaggacgugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaccaccguggacgacgacggcaccaugagaaucaaggacgacgagaccgagaacauccugaccgugcugcugaagaccgcccugaccaucgugagcggcguguuccccuacagcauccccgccacccugcugguguggcacaccuggcagaagcagacccagagaagcggcgugcugugggacgugcccagcccccccgagacccagaaggccgagcaggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaccuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaccaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17771 - RNA, 9873 nt, Artificial Sequence
  derived and/or modified CDS sequence (opt4) from DENV-3__JF808123__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccaccuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccugggccccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaccggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17772 - RNA, 9873 nt, Artificial Sequence
  derived and/or modified CDS sequence (opt4) from DENV-3__JF808128__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagagaaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguuccuggaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaagagcaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccgcccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccuggugagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaagauggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagaagcaugagcuggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17773 - RNA, 9873 nt, Artificial Sequence
  derived and/or modified CDS sequence (opt4) from DENV-3__JF808122__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaucaagugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccccccaccuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaccggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagcuuccugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugagcuggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaacggcagcagagccaucugguacauguggcugggcgccagauaccuggaguucgaggcccugggcuuccugaaggaguaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaccggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17774 - RNA, 9873 nt, Artificial Sequence
  derived and/or modified CDS sequence (opt4) from DENV-3__GQ466079__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcuucuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccuggagaaccuggagcuggacuucaccuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcauccugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcauccugggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugagcgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaucaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcaguggcugguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccgccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccaaggccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcagcagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacugcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17775 - RNA, 9873 nt, Artificial Sequence
  derived and/or modified CDS sequence (opt4) from DENV-3__FJ898462__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagagaggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaucguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17776 - RNA, 9873 nt, Artificial Sequence
  derived and/or modified CDS sequence (opt4) from DENV-3__KF955473__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccauccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17777 - RNA, 9873 nt, Artificial Sequence
  derived and/or modified CDS sequence (opt4) from DENV-3__FJ850079__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacguggaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaccggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacgacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17778 - RNA, 9873 nt, Artificial Sequence
  derived and/or modified CDS sequence (opt4) from DENV-3__FJ850080__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggacgagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagguggccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucauguucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucaucaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaagauccugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17779 - RNA, 9873 nt, Artificial Sequence
  derived and/or modified CDS sequence (opt4) from DENV-3__FJ850083__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcagcacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagagagaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggacgagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaccaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaagauccugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17780 - RNA, 9873 nt, Artificial Sequence
  derived and/or modified CDS sequence (opt4) from DENV-3__FJ850086__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagagccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggacgagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagaccgugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagguggccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucauguucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucaucaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaagauccugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17781 - RNA, 9873 nt, Artificial Sequence
  derived and/or modified CDS sequence (opt4) from DENV-3__FJ850089__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcagcacgagaaccugaaguacaccgugaucaucaccgugcacaccggcgaccagcaccaggugggcaacgagacccagggcgugaccgccgagaucaccccccaggccagcaccaccgaggugauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggacgagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaaggugggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcagaucaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaagauccugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17782 - RNA, 9873 nt, Artificial Sequence
  derived and/or modified CDS sequence (opt4) from DENV-3__FJ850092__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcagcacgagaaccugaaguacaccgugaucaucaccgugcacaccggcgaccagcaccaggugggcaacgagacccagggcgugaccgccgagaucaccccccaggccagcaccaccgaggugauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgugaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggacgagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaaggugggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaucguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaagauccugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17783 - RNA, 9873 nt, Artificial Sequence
  derived and/or modified CDS sequence (opt4) from DENV-3__FJ850094__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccggcacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggacgagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcguggugaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacaccuucaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacggcaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaagauccugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17784 - RNA, 9873 nt, Artificial Sequence
  derived and/or modified CDS sequence (opt4) from DENV-3__FJ898446__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaccggcgacaacgcccugaagaucaacugguacaagaagggcagcagcaucggcaagauguucgagaccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17785 - RNA, 9873 nt, Artificial Sequence
  derived and/or modified CDS sequence (opt4) from DENV-3__GU131844__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcugaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaccggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacgugaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgcccagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucgcccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcagcggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcuggccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17786 - RNA, 9873 nt, Artificial Sequence
  derived and/or modified CDS sequence (opt4) from DENV-3__GU131849__SS-prME
accagccugugccuggugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaucgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacagaggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcauccugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacaugacccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccaugcugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccacccccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucaucagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacagccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17787 - RNA, 9873 nt, Artificial Sequence
  derived and/or modified CDS sequence (opt4) from DENV-3__GQ868546__SS-prME
accagccugugccuggugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacagaggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcauccugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacaugacccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccacccccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucaucagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17788 - RNA, 9873 nt, Artificial Sequence
  derived and/or modified CDS sequence (opt4) from DENV-3__GU131850__SS-prME
accagccugugccuggugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacagaggcgaggacgcccccugcaagauccccuucagcaccgaggacggccagggcaaggcccacaacggcagacugaucaccgccaaccccguggugaucaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcauccugcugaccuggaucggccugaacagcaagaacaccagcaugagcuucagcugcaucgccaucggcaucaucacccuguaccugggcgccguggugcaggccgacaucggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacaugacccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucaucagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaacagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagaagggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17789 - RNA, 9873 nt, Artificial Sequence
  derived and/or modified CDS sequence (opt4) from DENV-3__GU131851__SS-prME
accagccugugccuggugaugauccugcccgccgcccuggccuuccaccugaccagcagagacggcgagccccacaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacaguggcuguucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacagaggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcauccugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacaugacccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccacccccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucaucagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17790 - RNA, 9873 nt, Artificial Sequence
  derived and/or modified CDS sequence (opt4) from DENV-3__GQ868547__SS-prME
accagccugugccuggugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacagaggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcauccugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagauggugaccgccgagacccagaacagcagcuucaucaucgacggccccaacacccccgagugccccagcgccagcagagccuggaacgugugggagguggaggacuacggcuucggcguguucaccaccaacaucuggcugaagcugagagaggugcacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacaugacccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccacccccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucaucagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17791 - RNA, 9873 nt, Artificial Sequence
  derived and/or modified CDS sequence (opt4) from DENV-3__GU131857__SS-prME
accagccugugccuggugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacagaggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcauccugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacaugacccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccacccccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucaucagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17792 - RNA, 9873 nt, Artificial Sequence
  derived and/or modified CDS sequence (opt4) from DENV-3__GU131858__SS-prME
accagccugugccuggugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacagaggcgaggacgcccccugcaagauccccuucagcaccgaggacggccagggcaaggcccacaacggcagacugaucaccgccaaccccguggugaucaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcauccugcugaccuggaucggccugaacagcaagaacaccagcaugagcuucagcugcaucgccaucggcaucaucacccuguaccugggcgccguggugcaggccgacaucggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagcggccccagccugaccaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacaugacccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucaucagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaacagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17793 - RNA, 9873 nt, Artificial Sequence
  derived and/or modified CDS sequence (opt4) from DENV-3__GQ868548__SS-prME
accagccugugccuggugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcagcacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacagaggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcauccugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacaugacccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccacccccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucaucagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17794 - RNA, 9873 nt, Artificial Sequence
  derived and/or modified CDS sequence (opt4) from DENV-3__GU131861__SS-prME
accagccugugccuggugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacagaggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcauccugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacaugacccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccacccccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucaucagagaggccaucaagagaagacugagaacccugauccuggcccccaccagagugguggccgccgagauggaggaggcccugaagggccugcccaucagauaccagaccaccgugaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccguggugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagagaaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagaagaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17795 - RNA, 9873 nt, Artificial Sequence
  derived and/or modified CDS sequence (opt4) from DENV-3__GU131862__SS-prME
accagccugugccuggugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacagaggcgaggacgcccccugcaagauccccuucagcaccgaggacggccagggcaaggcccacaacggcagacugaucaccgccaaccccguggugaucaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcauccugcugaccuggaucggccugaacagcaagaacaccagcaugagcuucagcugcaucgccaucggcaucaucacccuguaccugggcgccguggugcaggccgacaucggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacaugacccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucaucagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucacccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaacagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggaagacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17796 - RNA, 9873 nt, Artificial Sequence
  derived and/or modified CDS sequence (opt4) from DENV-3__GU131865__SS-prME
accagccugugccuggugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacagaggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcauccugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacaugacccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccacccccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucaucagagaggccaucaagagaagacugagaacccugauccuggcccccaccagagugguggccgccgagauggaggaggcccugaagggccugcccaucagauaccagaccaccgugaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccguggugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagagaaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugaccggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggugcagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17797 - RNA, 9873 nt, Artificial Sequence
  derived and/or modified CDS sequence (opt4) from DENV-3__GU131866__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacagaagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcugaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacgccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagaaagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17798 - RNA, 9873 nt, Artificial Sequence
  derived and/or modified CDS sequence (opt4) from DENV-3__GU131868__SS-prME
accccccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcugaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaacaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaaggccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccagcgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccagcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccguguuccugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17799 - RNA, 9873 nt, Artificial Sequence
  derived and/or modified CDS sequence (opt4) from DENV-3__GU131869__SS-prME
accagccugugccuggugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacagaggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaucgccugggacuucggcagcgugggcggcgugcugaacagccugggcaagauggugcaccagaucuucggcagcgccuacaccgcccuguucagcggcgugagcugggugaugaagaucggcaucggcauccugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacaugacccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccacccccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucaucagagaggccaucaagagaagacugagaacccugauccuggcccccaccagagugguggccgccgagauggaggaggcccugaagggccugcccaucagauaccagaccaccgccaccagaagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17800 - RNA, 9873 nt, Artificial Sequence
  derived and/or modified CDS sequence (opt4) from DENV-3__GU131870__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacagaggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcauccugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaaccacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacaugacccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaucguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucaucagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugguggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17801 - RNA, 9873 nt, Artificial Sequence
  derived and/or modified CDS sequence (opt4) from DENV-3__GU131871__SS-prME
accagccugugccuggugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccaccggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacagaggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcauccugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacaugacccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccacccccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucaucagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagagaaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17802 - RNA, 9873 nt, Artificial Sequence
  derived and/or modified CDS sequence (opt4) from DENV-3__GU131872__SS-prME
accagccugugccuggugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacagaggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcauccugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagauggugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacaugacccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccacccccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucaucagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17803 - RNA, 9873 nt, Artificial Sequence
  derived and/or modified CDS sequence (opt4) from DENV-3__GU131873__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcugaucgagggcaagguggugcaguacgagaaccugaaguacaccguggugaucaccgugcacaccggcgaccagcaccaggugggcaacgagacccagggcaucaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacgugaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguucaucaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17804 - RNA, 9873 nt, Artificial Sequence
  derived and/or modified CDS sequence (opt4) from DENV-3__GU131874__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcugaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaccggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcaccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgcccagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagagacccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucgcccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcagcggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcuggccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17805 - RNA, 9873 nt, Artificial Sequence
  derived and/or modified CDS sequence (opt4) from DENV-3__GU131875__SS-prME
accagccugugccuggugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacagaggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcauccugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacaugacccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucaucagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaagguggacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17806 - RNA, 9873 nt, Artificial Sequence
  derived and/or modified CDS sequence (opt4) from DENV-3__GU131877__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacagaggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggugauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucaucagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucaucagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucagcggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugauccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugagcgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17807 - RNA, 9873 nt, Artificial Sequence
  derived and/or modified CDS sequence (opt4) from DENV-3__GU131878__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagagaagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcugaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaccggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgccaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17808 - RNA, 9873 nt, Artificial Sequence
  derived and/or modified CDS sequence (opt4) from DENV-3__FJ898455__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacgugaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaaggccgugcagcacgagaaccugaaguacaccgugaucaucaccgugcacaccggcgaccagcaccaggugggcaacgagacccagggcgugaccgccgagaucaccccccaggccagcaccguggaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaccagcggcggcaccagcaucuucgccggccaccugaagugcagacugaagauggacaagcuggagcugaagggcaugagcuacgccaugugccugaacgccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccaucgugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccaucguggugggcgacgugaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagauguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaaggccgacaacuucaccaugggcgugcugugccuggccauccuguucgaggaggugaugagaggcaaguucggcaagaagcacaugaucgccggcgcccuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaugugcagcaacaccaucuucacccugaccguggccuggagaaccgccacccugauccuggccgugaucagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagcuuccugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcacaaggagggcguguuccacaccauguggcacgugaccagaggcgccgugcugacccacaacggcaagagacuggagcccaacugggccaacgugaagaaggaccugaucagcuacggcggcggcuggaagcugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucgugauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugguggccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggccuucugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucagaagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaucaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcuggagaagaaggugacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagaugugggcccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 17809 - RNA, 9873 nt, Artificial Sequence
  derived and/or modified CDS sequence (opt4) from DENV-3__GQ199891__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaaggccgugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17810 - RNA, 9873 nt, Artificial Sequence
  derived and/or modified CDS sequence (opt4) from DENV-3__FJ898443__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaaggccgugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaccggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaugaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagcuggagggcgccaucugguga

SEQ ID NO: 17811 - RNA, 9873 nt, Artificial Sequence
  derived and/or modified CDS sequence (opt4) from DENV-3__FJ898444__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacgagcagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcguggugaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggccuacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcagagagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagaagggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17812 - RNA, 9873 nt, Artificial Sequence
  derived and/or modified CDS sequence (opt4) from DENV-3__FJ898445__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaaggccgugaucuucacccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagagagaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggauggagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggccuacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggcaugcuggagaccaccaagagagaccugggcaugagcaaggagcccggcguggccagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugauccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccagaaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17813 - RNA, 9873 nt, Artificial Sequence
  derived and/or modified CDS sequence (opt4) from DENV-3__GQ868571__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaaggccgugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggcaugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17814 - RNA, 9873 nt, Artificial Sequence
  derived and/or modified CDS sequence (opt4) from DENV-3__GU131951__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccaugagcaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgaggcccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugacccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaucguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17815 - RNA, 9873 nt, Artificial Sequence
  derived and/or modified CDS sequence (opt4) from DENV-3__GQ868572__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaaggccgugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggugcacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17816 - RNA, 9873 nt, Artificial Sequence
  derived and/or modified CDS sequence (opt4) from DENV-3__GQ868573__SS-prME
accagcuucugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaaggccgugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggccugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17817 - RNA, 9873 nt, Artificial Sequence
  derived and/or modified CDS sequence (opt4) from DENV-3__GQ868574__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaaggccgugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucagcuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggcaugcuggagaccaccaagagagaccugggcaugagcaaggagcccggcguggccagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17818 - RNA, 9873 nt, Artificial Sequence
  derived and/or modified CDS sequence (opt4) from DENV-3__GQ868575__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaaggccgugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacuucagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacaagaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucggccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcagagagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagauccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17819 - RNA, 9873 nt, Artificial Sequence
  derived and/or modified CDS sequence (opt4) from DENV-3__GU131953__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaaggccgugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacgccgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacugcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugagcgagaagaaggugacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17820 - RNA, 9873 nt, Artificial Sequence
  derived and/or modified CDS sequence (opt4) from DENV-3__GQ868577__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagaucgugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggccuacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucgcccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggagaacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17821 - RNA, 9873 nt, Artificial Sequence
  derived and/or modified CDS sequence (opt4) from DENV-3__GU131954__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggccuacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgugaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugaccaaggagcccggcgccgugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaaggugacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17822 - RNA, 9873 nt, Artificial Sequence
  derived and/or modified CDS sequence (opt4) from DENV-3__GQ868578__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagagcaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaaguggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaccagcgagaaggaggagaacauggugaagagccuggugagcgccggcagcggcgagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagaucgugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggccuacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccacccaccuggcccacagaaccagaaacgcccuggacaaccuggugaugcugcacaccagcgagcacggcggcaaggccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucgcccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaugggcaacgaggaguuccuggacuacaugcccagcaugaagagauucagaaaggaggaggagagcgagggcgccaucugguga

SEQ ID NO: 17823 - RNA, 9873 nt, Artificial Sequence
  derived and/or modified CDS sequence (opt4) from DENV-3__FJ898457__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcagcacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagaccgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17824 - RNA, 9873 nt, Artificial Sequence
  derived and/or modified CDS sequence (opt4) from DENV-3__KF955505__SS-prME
accagccugugccugaugaugauccugcccgccgcccuggccuuccaccugaccagcagaaacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugccccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcccaagcugggcuacauccugagagacaucagcaagauccccggcggcgccauguacgccgacgacaccgccggcugggacaccagaaucaccgaggacgaccugcacaacgaggagaagaucccccaccagauggaccccgagcacagcagacuggccaacgccaucuucaagcugaccuaccagaacaagguggugaaggugcagagacccacccccaccggcaccgugauggacaucaucagcagaaaggcccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucaccggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17825 - RNA, 9873 nt, Artificial Sequence
  derived and/or modified CDS sequence (opt4) from DENV-3__FJ898464__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17826 - RNA, 9873 nt, Artificial Sequence
  derived and/or modified CDS sequence (opt4) from DENV-3__JQ922556__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggcccccgccagaggcgccagaagaauggccauccugggcgacaccgccuggguguucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccagcacccccgagugccccagcgccagcagagccuggaacgugugggagguggaggacuacggcuucggcguguucaccaccaacaucuggcugaagcugagagagguguacacccagaugugcgaccacagacugaugagccccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggccuucaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugggcaccggcaccagcgccgaccugaccguggagcaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcauccugggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcccccaguggcagaagggcgaggaggugcaggugaucaccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaacagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgagaccgaguaccagaagaccaagcugaacgacugggacuucgugggcaccaccgacaucagcgagaugggcgccaacuucaaggccgacagagugaucgaccccagaagaugccugaagcccggcauccugaccgacggccccgagggcgugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaucaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcgugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaucaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagcugacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccgccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcggcagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccaaggccgccguggaggacgaggaguucuggaagcugguggacagagagagagagcugcacaagcugggcaagugcggcagcugcguguacaacaugaugggcggcagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacugcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugaccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17827 - RNA, 9873 nt, Artificial Sequence
  derived and/or modified CDS sequence (opt4) from DENV-3__JQ922557__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagagacugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagaugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcaagagcaagagagacaacagcaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugaugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugcugaucaccguggacgacaacggcaccaugagaaucaaggacgacgagaccgagaucauccugaccgugcugcugaagaccgcccugcagaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcauccugggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcgacuaccugagcggcaucgcccagaccaacgccgagcccuacggccccagccccgaccuggaggaggagauguucaagaagagaaagcugaccaucauggaccugcaccccggcagcggccagacccugaaguaccugcccgccaucgugagagacgccaucaagagaagacugagaauccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgccgagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgagaccgaguaccagaagaccaagcugaacgacugggacuucguggugaccaccgacaucagcgagaugggcgccaacuucaaggccgacagagugaucgaccccagaagaugccugaagcccgugauccugaccgacggccccaagagagugauccuggccggccccaugcccgacaccgccgccagcgccgcccagagaagaggcagagugggcagaaacccccagaaggagaacgaccaguacaucuuccccggccagccccugaacaccgacgaggaccacgcccacuggcccgagaccaagcugcugauggaccuguucaccacccccgagggcauccugcccagccacuucgacccccacggcgagaacuuccccgagaucagcggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggacagccaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaucaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaugaccacccugugggagggcagccccggcaagaucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccgccgugaucgagcaccuggagagacugcagagaaagcacggcggcaugcuggugagaaacccccugagcagaaacagcacccacgagaugcacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccaaggccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacugcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacccccccuaccugggcaagagagaggaccaguggugcggcagcaucaucggccugagcagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17828 - RNA, 9873 nt, Artificial Sequence
  derived and/or modified CDS sequence (opt4) from DENV-3__JQ922555__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagagcaucgagggcaagguggugcaguacgagaaccugaaguacaccgugaucaucaccgugcacaccggcgaccagcaccaggugggcaacgagacccagggcgugaccgccgagaucaccccccaggccagcaccgccgaggccauccugcccgaguacggcacccugggccuggagugcagccccagaaccggccuggacuucaacgagaugauccugcugaccaugaagaacaaggccuggaugggccacagacagaugcuguucgaccugcccacccccuggaccagcggcaccaccaccgagaccagcgccuggaacagaaaggagcccuucgugaccuucaagaacgcccacaccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccuggugaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacagaaagggcagcagcaucggcaagauguucgaggccaccagcagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagaucugcgaccacagacugaugagcgccgccgugaaggacgagagagccgugcacgccgacaugggcuacuggaucgagagccagaagaacggcagcuggaagcuggagaaggccagccugaucgaggugaagaccagcaccuggcccaagagccacacccuguggagcaacggcgugcaggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggccagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggccagaacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacggcgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccagcggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgacgccaagaugcugcuggagaacaucaacacccccgagggcaucauccccgcccuguucgagcccgagagagagaagagcgccggccuggacggcgaguacagacugaagggcgagagcagaaagaccuucguggagcugaugagaagaggcgaccugcccguguggcuggcccacaagguggccagcgagggcauccuguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugagcagccaccuggcccacagaaccagaaacgcccuggacaacaagaugaugcugcacaccagcgaguacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcgugagcaaggagcccggcguggugagccccaccagcuaccuggacguggaccugcaccccgccagcgccuggacccuguacgccguggccaccaccgugaucgcccccaugcugagacacaccaucgagaacagcaccgccaacgugagcauggccgccaucgccaaccaggccguggugcugaugggccuggacaagggcuggcccaucagcaagauggaccugggcgugccccugcuggcccugggcugcuacuucuacgugaacccccugacccugaccgccgccguguuccugcuggugacccacuacgccaucaucggccccggccugcaggccaaggccaccagagaggcccacaagaagaccgccgccggcaucaugaaccccccccccggcgacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaccaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcaagggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcagaaacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacugaugcccagaaccagaaaggugauggagaucaccgccgaguggcuguggagaacccugggcagaaacaagagacccagacugugcaccagagaggaguucaccaagaaggugagacccaucgccgccaugggcgccguguucacccagagagaccagugggacagcgccaaggccgccguggaggacgaggaguucuggaagcccguggacagagagugcaacagccaccagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaacaccgaggacgaccugcacaugaaggagaagaucacccagcagaugggccccggccacagcagacuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17829 - RNA, 9873 nt, Artificial Sequence
  derived and/or modified CDS sequence (opt4) from DENV-3__GU131903__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcagcacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacagcggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccaacgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugaacgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccuggugaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaaggccggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugagaaacaaccaguucugcaucaaggugcugaaccccuacauggccaccggcaucgagcaccuggagagacugcagagaaaguacggcggcaugcuggugagaaacccccugagcagaaacagcacccacgagauggacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17830 - RNA, 9873 nt, Artificial Sequence
  derived and/or modified CDS sequence (opt4) from DENV-3__GU131904__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacagcaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccuggugaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugagaaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugagaaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccauggccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17831 - RNA, 9873 nt, Artificial Sequence
  derived and/or modified CDS sequence (opt4) from DENV-3__GU131906__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccagaagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccuggugaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugagaaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcugggcaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17832 - RNA, 9873 nt, Artificial Sequence
  derived and/or modified CDS sequence (opt4) from DENV-3__GU131907__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcaacggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucgccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaccgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccuggugaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugagaaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacaaggagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagaccgagggcgccaucugguga

SEQ ID NO: 17833 - RNA, 9873 nt, Artificial Sequence
  derived and/or modified CDS sequence (opt4) from DENV-3__GQ868634__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgccaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugaacgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccuggugaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugagaaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17834 - RNA, 9873 nt, Artificial Sequence
  derived and/or modified CDS sequence (opt4) from DENV-3__GU131908__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgccaucaacuggaagggcaaggagcugaagugcggcagcggcaucuucgugaccaacgaggugcacaccuggaccgagcaguacaaguuccaggccgacagccccaagagacuggccaccgccaucgccggcgccuggaagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugaacgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccuggugaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugagaaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17835 - RNA, 9873 nt, Artificial Sequence
  derived and/or modified CDS sequence (opt4) from DENV-3__GU131909__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggccuucagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgccaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugaacgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccuggugaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugagaaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17836 - RNA, 9873 nt, Artificial Sequence
  derived and/or modified CDS sequence (opt4) from DENV-3__GU131912__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccaacaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccaucaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcaacggcaucuucgugaccaacgaggugcacaccuggaccgagcaguacaaguuccaggccgacagccccaagagacuggccaccgccaucgccggcagcugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucgccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaaagagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccagcaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugagaaugguggagcccuggcugagaaacaaccaguucugcaucaaggugcugaaccccuacaugcccaacgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacaaggagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcgaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17837 - RNA, 9873 nt, Artificial Sequence
  derived and/or modified CDS sequence (opt4) from DENV-3__GU131913__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccaucaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucgugacccuguaccugggcgccguggugcaggccgacaugggcugcgugaucaacuggaagggcaaggagcugaagugcggcaacggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagaggugcacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucgccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaaagagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccuggugaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugagaaacaaccaguucugcaucaaggugcugaaccccuacaugcccaacgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacaaggagagagagcugcacaagcugggcaagugcggcagcugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcgaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggaugggcgacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17838 - RNA, 9873 nt, Artificial Sequence
  derived and/or modified CDS sequence (opt4) from DENV-3__GU131914__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccaucaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcaacggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagaggugcacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucgccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaaagagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccuggugaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugagaaacaaccaguucugcaucaaggugcugaaccccuacaugcccaacgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacaaggagagagagcugcacaagcugggcaagugcggcagcugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcgaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggaugggcgacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17839 - RNA, 9873 nt, Artificial Sequence
  derived and/or modified CDS sequence (opt4) from DENV-3__GU131915__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgaggccgagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcagcacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacagcggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugaacgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccuggugaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugagaaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17840 - RNA, 9873 nt, Artificial Sequence
  derived and/or modified CDS sequence (opt4) from DENV-3__GU131916__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcgugaucaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccuggugaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccagcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugagaaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgaggacgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguucagcgacuacaugcccagcaugaagagauucagaaaggaggaggagagcgagggcgccaucugguga

SEQ ID NO: 17841 - RNA, 9873 nt, Artificial Sequence
  derived and/or modified CDS sequence (opt4) from DENV-3__GU131917__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucacccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcaacggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucgccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccuggugaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaagcgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugagaaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacaaggagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucauccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugagcguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17842 - RNA, 9873 nt, Artificial Sequence
  derived and/or modified CDS sequence (opt4) from DENV-3__GU131918__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcaacggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccuggugaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaagcgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugagaaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacaaggagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucauccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugagcguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17843 - RNA, 9873 nt, Artificial Sequence
  derived and/or modified CDS sequence (opt4) from DENV-3__GU131933__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacagcaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaugggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccuggugaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugagaaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccauggccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17844 - RNA, 9873 nt, Artificial Sequence
  derived and/or modified CDS sequence (opt4) from DENV-3__GU131934__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggaucgacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcgugaucacccuguaccugggcgccguggugcaggccgacaugggcugcgugaucaacuggaagggcaaggagcugaagugcggcaacggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagaaccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucgccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccauccccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccuggugaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugagaaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacaaggagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagaccgagggcgccaucugguga

SEQ ID NO: 17845 - RNA, 9873 nt, Artificial Sequence
  derived and/or modified CDS sequence (opt4) from DENV-3__GU131935__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgccaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugaacgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccuggugaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgugaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcaccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugagaaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 17846 - RNA, 9873 nt, Artificial Sequence
  derived and/or modified CDS sequence (opt4) from DENV-3__GU131936__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagagcaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcaacggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagagcccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucgccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugaagaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccuggugaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugagaagcaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacaaggagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagaccgagggcgccaucugguga

SEQ ID NO: 17847 - RNA, 9873 nt, Artificial Sequence
  derived and/or modified CDS sequence (opt4) from DENV-3__GU131937__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcacccugagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccuggugaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugaucagccugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagaacagaaccaucagagugcugaagaugguggagcccuggcugagaaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17848 - RNA, 9873 nt, Artificial Sequence
  derived and/or modified CDS sequence (opt4) from DENV-3__GU131938__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagagcaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcaacggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagagcccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucgccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugaagaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccuggugaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaugggccagccccugaacaacgacgaggaccacgcccacuggaccgaggccaagaugcugcuggacaacaucaacacccccgaggccaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugagaagcaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacaaggagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagaccgagggcgccaucugguga

SEQ ID NO: 17849 - RNA, 9873 nt, Artificial Sequence
  derived and/or modified CDS sequence (opt4) from DENV-3__GU131939__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccaucaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcaacggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucgccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaaagagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagagagugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugagaaacaaccaguucugcaucaaggugcugaaccccuacaugcccaacgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacaaggagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcgaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17850 - RNA, 9873 nt, Artificial Sequence
  derived and/or modified CDS sequence (opt4) from DENV-3__GU131940__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcaccguggugcaggccgacaugggcugcgccaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugaacgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccuggugaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggccuacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugagaaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17851 - RNA, 9873 nt, Artificial Sequence
  derived and/or modified CDS sequence (opt4) from DENV-3__GU131942__SS-prME
accagccugugccugaugaugauguuccccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacagcggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccguguucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugaacgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccuggugaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcgccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugagaaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17852 - RNA, 9873 nt, Artificial Sequence
  derived and/or modified CDS sequence (opt4) from DENV-3__GU131943__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaucuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgccaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcugugggccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugaacgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccuggugaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugagaaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17853 - RNA, 9873 nt, Artificial Sequence
  derived and/or modified CDS sequence (opt4) from DENV-3__GU131945__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagagcaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcaacggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagagcccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucgccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugaagaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccuggugaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugagaagcaaccaguucugcaucaaggugcugaaccccuacaugcccaccgugaucgaguaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacaaggagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagaccgagggcgccaucugguga

SEQ ID NO: 17854 - RNA, 9873 nt, Artificial Sequence
  derived and/or modified CDS sequence (opt4) from DENV-3__GU131946__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcauccugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccagaaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccuggugaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuuccuggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaagcgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugagaaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacaacgccagagccgccguggaggacgaggaguucuggaagcugguggacagagagagagagcugcacaagcugggcaagugcggcagcugcaucuacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggacagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17855 - RNA, 9873 nt, Artificial Sequence
  derived and/or modified CDS sequence (opt4) from DENV-3__FJ639712__SS-prME
accagccugugccugaugaugauguuccccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacagcggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugaacgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccuggugaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgagugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacgccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugagaaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17856 - RNA, 9873 nt, Artificial Sequence
  derived and/or modified CDS sequence (opt4) from DENV-3__FJ639713__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcaacggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucgccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccuggugaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaagcgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugagaaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacaaggagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucauccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugagcguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17857 - RNA, 9873 nt, Artificial Sequence
  derived and/or modified CDS sequence (opt4) from DENV-3__FJ639714__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcaacggcaucuucgugaccaacgaggugcacaccuggaccgagcaguacaaguuccaggccgacagccccaagagacuggccaccgccaucgccggcgccugggagagcggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucgccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccuggugaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccaucaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugagaaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacaaggagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccggccacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagaccgagggcgccaucugguga

SEQ ID NO: 17858 - RNA, 9873 nt, Artificial Sequence
  derived and/or modified CDS sequence (opt4) from DENV-3__FJ639715__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccaacaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccaucaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcaacggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucgccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaaagagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugagaaacaaccaguucugcaucaaggugcugaaccccuacaugcccaacgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacaaggagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcgaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17859 - RNA, 9873 nt, Artificial Sequence
  derived and/or modified CDS sequence (opt4) from DENV-3__KF955461__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagguguucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggccaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccuggugaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccagcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17860 - RNA, 9873 nt, Artificial Sequence
  derived and/or modified CDS sequence (opt4) from DENV-3__FJ639719__SS-prME
accagccugugccugaugaugaugcugcccgccacccuggccuuccaccugaccagcagagacggcgagcccagaaugaucgugggcaagaacgagagaggcaagagccugcuguucaagaccgccaccggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugauccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugacccaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcacccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccuggugagcggcaagggcaucggcaagaccaccaucggccugaucugcgugaucgugagcagcggcaugcuguggauggccgacaucccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaacaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17861 - RNA, 9873 nt, Artificial Sequence
  derived and/or modified CDS sequence (opt4) from DENV-3__KF955332__SS-prME
accagccugugccugaugaugaugcugcccgccacccuggccuuccaccugaccagcagagacggcgagcccagaaugaucgugggcaagaacgagagaggcaagagccugcuguucaagaccgccaccggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugauccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacgcccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcacccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccuggugagcggcaagggcaucggcaagaccaccaucggccugaucugcgugaucgugagcagcggcaugcuguggauggccgacaucccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaagaccgaccuggagaacccccaccugcuggagaagaagaucacccaguggcuggagaacaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17862 - RNA, 9873 nt, Artificial Sequence
  derived and/or modified CDS sequence (opt4) from DENV-3__FJ639720__SS-prME
accagccugugccugaugaugaugcugcccgccacccuggccuuccaccugaccagcagagacggcgagcccagaaugaucgugggcaagaacgagagaggcaagagccugcuguucaagaccgccaccggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugauccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugagaaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcacccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgccaucgaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccuggugagcggcaagggcaucggcaagaccaccaucggccugaucugcgugaucgugagcagcggcaugcuguggauggccgacaucccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaagaccgaccuggagaacccccaccugcuggagaagaagaucacccaguggcuggagaacaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17863 - RNA, 9873 nt, Artificial Sequence
  derived and/or modified CDS sequence (opt4) from DENV-3__GQ868626__SS-prME
accagccugugccugaugaugaugcugcccgccacccuggccuuccaccugaccagcagagacggcgagcccagaaugaucgugggcaagaacgagagaggcaagagccugcuguucaagaccgccaccggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugauccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaucgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugagaaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcacccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggccuacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccaccaucggccugaucugcgugaucgugagcagcggcaugcuguggauggccgacaucccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaacaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcuggccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17864 - RNA, 9873 nt, Artificial Sequence
  derived and/or modified CDS sequence (opt4) from DENV-3__GQ868627__SS-prME
accagccugugccugaugaugaugcugcccgccacccuggccuuccaccugaccagcagagacggcgagcccagaaugaucgugggcaagaacgagagaggcaagagccugcuguucaagaccgccaccggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugauccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugagaaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcacccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggccuacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccaccaucggccugaucugcgugaucgugagcagcggcaugcuguggauggccgacaucccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaacaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcuggccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17865 - RNA, 9873 nt, Artificial Sequence
  derived and/or modified CDS sequence (opt4) from DENV-3__FJ639721__SS-prME
accagccugugccugaugaugaugcugcccgccacccuggccuuccaccugaccagcagagacggcgagcccagaaugaucgugggcaagaacgagagaggcaagagccugcuguucaagaccgccaccggcaucaacaugugcacccugaucgccauggaccugggcgagaugugcgacgacaccgugaccuacaagugcccccugaucguggagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugauccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccugacccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacgcccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcacccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccuggugagcggcaagggcaucggcaagaccaccaucggccugaucugcgugaucgugagcagcggcaugcuguggauggccgacaucccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaagaccgaccuggagaacccccaccugcuggagaagaagaucacccaguggcuggagaacaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17866 - RNA, 9873 nt, Artificial Sequence
  derived and/or modified CDS sequence (opt4) from DENV-3__FJ639722__SS-prME
accagccugugccugaugaugaugcugcccgccacccuggccuuccaccugaccagcagagacggcgagcccagaaugaucgugggcaagaacgagagaggcaagagccugcuguucaagaccgccaccggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugauccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgagaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacgcccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcacccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccuggugagcggcaagggcaucggcaagaccaccaucggccugaucugcgugaucgugagcagcggcaugcuguggauggccgacaucccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaagaccgaccuggagaacccccaccugcuggagaagaagaucacccaguggcuggagaacaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17867 - RNA, 9873 nt, Artificial Sequence
  derived and/or modified CDS sequence (opt4) from DENV-3__FJ639723__SS-prME
accagccugugccugaugaugaugcugcccgccacccuggccuuccaccugaccagcagagacggcgagcccagaaugaucgugggcaagaacgagagaggcaagagccugcuguucaagaccgccaccggcaucaacaugugcacccugaucgccauggaccugggcgagaugugcgacgacaccgugaccuacaagugcccccugaucgccgagguggagcccgaggacaucgacugcuggugcaaccugaccagcgccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugauccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugagaaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaccaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcacccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggccuacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccaccaucggccugaucugcgugaucgugagcagcggcaugcuguggauggccgacaucccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaacaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcuggccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17868 - RNA, 9873 nt, Artificial Sequence
  derived and/or modified CDS sequence (opt4) from DENV-3__FJ639724__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagagaguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccaccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccuggugaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugagaaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17869 - RNA, 9873 nt, Artificial Sequence
  derived and/or modified CDS sequence (opt4) from DENV-3__FJ639725__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccuggugaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugagaaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcugggcaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17870 - RNA, 9873 nt, Artificial Sequence
  derived and/or modified CDS sequence (opt4) from DENV-3__FJ639726__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagagaguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccuggugaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugagccccgagaagugcgacacccugcugugcgacaucggcgagagcagccccagccccaccguggaggagagcagaaccaucagagugcugaagaugguggagcccuggcugagaaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17871 - RNA, 9873 nt, Artificial Sequence
  derived and/or modified CDS sequence (opt4) from DENV-3__KF955333__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgccaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgcccacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaagcccgccgacgugcccugggaggaggaggccgagcagaccggcgugagccacaaccugaugaucaccguggacgacgacggccccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugaacgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccuggugaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugagaaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucaccgcccagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17872 - RNA, 9873 nt, Artificial Sequence
  derived and/or modified CDS sequence (opt4) from DENV-3__GQ868628__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcgccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccuggugaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugagaaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17873 - RNA, 9873 nt, Artificial Sequence
  derived and/or modified CDS sequence (opt4) from DENV-3__FJ639727__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaagagccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuacuacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgcccuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugguggugauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucagagccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugagaaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17874 - RNA, 9873 nt, Artificial Sequence
  derived and/or modified CDS sequence (opt4) from DENV-3__GQ868629__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaucaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccuggugaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugagaaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17875 - RNA, 9873 nt, Artificial Sequence
  derived and/or modified CDS sequence (opt4) from DENV-3__FJ639728__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgcccugagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccuggugaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugagaaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17876 - RNA, 9873 nt, Artificial Sequence
  derived and/or modified CDS sequence (opt4) from DENV-3__FJ639729__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaucaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccuggugaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugagaaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggaaccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17877 - RNA, 9873 nt, Artificial Sequence
  derived and/or modified CDS sequence (opt4) from DENV-3__FJ639730__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgccaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagaaggccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugaacgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacaaggagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccuggugaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgagcuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugagaaacaaccaguucugcaucaaggugcugaaccccuacaugcccaccgugaucgagcaccuggagaagcugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17878 - RNA, 9873 nt, Artificial Sequence
  derived and/or modified CDS sequence (opt4) from DENV-3__KF955464__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccauccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccaacaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccaucaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcaacggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucgccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaaagagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugagaaugguggagcccuggcugagaaacaaccaguucugcaucaaggugcugaaccccuacaugcccaacgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacaaggagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcgaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgcccacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17879 - RNA, 9873 nt, Artificial Sequence
  derived and/or modified CDS sequence (opt4) from DENV-3__FJ639731__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccgugcugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgccaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagauggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugaacgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacaaggagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccuggugaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugagaaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17880 - RNA, 9873 nt, Artificial Sequence
  derived and/or modified CDS sequence (opt4) from DENV-3__HM181933__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgccaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaagacccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugaacgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccuggugaucauggacgaggcccacuucaccgaccccgccagcaucgccgccagaggcuacaucagcaccagagugggcaugggcgaggccgccgccaucuucaugaccgccaccccccccggcaccgccgaggccuucccccagagcaacgcccccauccaggacgaggagagagacauccccgagagaagcuggaacagcggcaacgaguggaucaccgacuucgugggcaagaccgugugguucgugcccagcaucaaggccggcaacgacaucgccaacugccugagaaagaacggcaagaaggugauccagcugagcagaaagaccuucgacaccgaguaccagaagaccagacugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugagaaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17881 - RNA, 9873 nt, Artificial Sequence
  derived and/or modified CDS sequence (opt4) from DENV-3__JF295012__SS-prME
accagccugugccugaugaugaugcugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccugaucgccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagagcaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgacacccagggcgugaccguggagaucaccccccaggccagcaccguggaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugccugaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaaggcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcuggaucaugaagaucggcaucggcgugcugcugaccuggaucggccugaacagcaagaacaccagcaugagcuucagcugcaucgugaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagagcugcgaccacagacugaugagcgccgccaucaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucaacgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugaugacccugaagcugaucacccaguucgagaccuaccagcuguggaccgcccuggugagccugaccugcagcaacaccaucuucacccugaccguggccuggagaaccgccacccugauccuggccggcgugagccugcugccccugugccagagcagcagcaugagaaagaccgacuggcugcccaugaccguggccgccaugggcgugcccccccugccccuguucaucuucagccugaaggacacccccaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaucuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccuggugaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagagaaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgugagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucguggccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcuggugacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcagaagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugagaaacaaccaguucugcaucaaggugcugaaccccuacaugcccaccgugaucgagcaccuggagagacugcagagaaaguacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacagcagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagaagcccagacugugcaccagagaggaguucaccaagaaggugagaaccaacgccgccaugggcgccguguucaccgaggagaaccagugggacagcgccagagccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaagggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacuggauccccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcgacgaggaguuccuggacuacaugcccagcaugaagagauucagaaaggaggaggagagcgagggcgccaucugguga

SEQ ID NO: 17882 - RNA, 9873 nt, Artificial Sequence
  derived and/or modified CDS sequence (opt4) from DENV-3__FJ898463__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcaccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacagccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggaccacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17883 - RNA, 9873 nt, Artificial Sequence
  derived and/or modified CDS sequence (opt4) from DENV-3__GQ868616__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcaccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcguguuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacagccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgcccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucacccccgaguggcuguggagaccccugggcagaaacaagaagcccagacugugccccagagaggaguucaccaagaaggugagaaccaacgcccccaugggcgccguguucaccgaggagacccagugggccagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcccaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17884 - RNA, 9873 nt, Artificial Sequence
  derived and/or modified CDS sequence (opt4) from DENV-3__GQ199887__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagagcaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccuggugaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagauccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggccagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaccugcagcaacaccauguucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcauccugggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucagaaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgugaugcuguuccugaucagcggcaagggcaucggcaagaccagcaucggccugaucugcgugaucgccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagagagacguggaccugggcgccggcaccagacacgugaacgccgagcccgagauccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccaaggccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17885 - RNA, 9873 nt, Artificial Sequence
  derived and/or modified CDS sequence (opt4) from DENV-3__GQ199888__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagagcaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccuggugaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaccggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagauccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggccagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaccugcagcaacaccauguucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcauccugggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucagaaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagagagacguggaccugggcgccggcaccagacacgugaacgccgagcccgagauccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccaaggccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcuggugagacagauggagggcgaggacgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17886 - RNA, 9873 nt, Artificial Sequence
  derived and/or modified CDS sequence (opt4) from DENV-3__GQ252674__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcaucggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagacguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaccugcagcaacaccauccugacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaacgccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagagaggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccauccccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaaaggugaugggcaucaccgccgaguggcuguggagaacccugggcagaaacaagagacccagacugugcaccagagaggaguucaccaagaaggugagaaccaacgccgccaugggcgccguguucaccgaggagaaccagugggacagcgccaaggccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagacaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggugcagcuggugagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggagaacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17887 - RNA, 9873 nt, Artificial Sequence
  derived and/or modified CDS sequence (opt4) from DENV-3__GQ199889__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugauccuggugacccccagcauggccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccauccugcccgaggagcaggaccagaacuacgugugcaagcacaccuacguggacagaggcuggggcaacggcugcggccuguucggcaagggcagccuggugaccugcgccaaguuccagugccuggagagcaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaccggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagauccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggccagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggcaugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcauccugggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccagcgccgagcccgacggccccacccccgagcuggaggaggagauguucagaaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccaccagacacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagagagacguggaccugggcgccggcaccagacacgugaacgccgagcccgagauccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccaaggccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17888 - RNA, 9873 nt, Artificial Sequence
  derived and/or modified CDS sequence (opt4) from DENV-3__FJ882571__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagacguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugcuguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaccugcagcaacaccauccugacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaucguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcauccugggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugaugggcaucaccgccgaguggcuguggagaacccugggcagaaacaagagacccagacugugcaccagagaggaguucaccaagaaggugagaaccaacgccgccaugggcgccguguucaccgaggagaaccagugggacagcgccaaggccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagacaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggugcagcuggugagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcaugcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcuggccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccugaccgccauccagcaggugagaagccugaucggcaacgaggaguuccuggacuacaugcccagcaugaagagauucagaaaggaggaggagagcgagggcgccaucugguga

SEQ ID NO: 17889 - RNA, 9873 nt, Artificial Sequence
  derived and/or modified CDS sequence (opt4) from DENV-3__FJ882572__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagagcaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaccggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagauccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagcuucaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggccagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccauguucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggcaugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcauccugggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccagcgccgagcccgacggccccacccccgagcuggaggaggagauguucagaaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgacgugccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaccacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagagagacguggaccugggcgccggcaccagacacgugaacgccgagcccgagauccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccaaggccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcuggagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17890 - RNA, 9873 nt, Artificial Sequence
  derived and/or modified CDS sequence (opt4) from DENV-3__FJ882573__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccugggccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacacccccaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaccggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccuggugagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcauccugggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgaggugccccugcaguggaucgccagcgccaucgugcuggaguucuucaugauggugcugcugauccccgagcccgagaagcagagaaccccccaggacaaccagcuggccuacguggugaucggcauccugacccuggccgccaugaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacaugguggugcccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagagugaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugauggagaucaccgccgaguggcuguggagaacccugggcagaaacaagagacccagacugugcaccagagaggaguucaccaagaaggugagaaccaacgccgccaugggcgccguguucaccgaggagaaccagugggacagcgccaaggccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucauccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcuggugagacagauggagggcgagggcgugcugaccaaggccgaccuggagaacccccaccugcuggagaagaagaucacccaguggcuggaggccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggagaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17891 - RNA, 9873 nt, Artificial Sequence
  derived and/or modified CDS sequence (opt4) from DENV-3__FJ898440__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaucaccgaggccauccugcccgaguacggcacccugggccuggagugcagccccagaaccggccuggacuucaacgagauggugcugcugaccaugaagaacaaggccuggauggugcacagacagugguucuucgaccugccccugcccuggaccagcggcgccaccaccgagacccccaucuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaccggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcagccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagaaggaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagaugaaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17892 - RNA, 9873 nt, Artificial Sequence
  derived and/or modified CDS sequence (opt4) from DENV-3__FJ898441__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagauggugcaguacgagaaccugaaguacaccgugaucaucaccgugcacaccggcgaccagcaccaggugggcaacgagacccagggcgugaccgccgagaucaccccccaggccagcaucaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccaccaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagguguucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaccggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgugggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgccgacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcagccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagaaggaccugggcaugagcaaggagcccggcguggugagcagcaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugaccggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagagagacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaaaggugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaccauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17893 - RNA, 9873 nt, Artificial Sequence
  derived and/or modified CDS sequence (opt4) from DENV-3__FJ898442__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagauggugcaguacgagaaccugaaguacaccgugaucaucaccgugcacaccggcgaccagcaccaggugggcaacgagacccagggcgugaccgccgagaucaccccccaggccagcaucaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccaccaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagguguucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaccggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccagaagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgccgacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcagccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagaaggaccugggcaugagcaaggagcccggcguggugagcagcaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugaccggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagagagacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaaaggugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaccauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgagaacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17894 - RNA, 9873 nt, Artificial Sequence
  derived and/or modified CDS sequence (opt4) from DENV-3__FJ882575__SS-prME
accagccugugccugaugaugauccugcccgccacccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcauccugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcauccugggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacguggacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagacccaugcccggcaccagaaaggugaugggcaucaccgccgaguggcuguggagaacccugggcagaaacaagagacccagacugugcaccagagaggaguucaccaagaaggugagaaccaacgccgccaugggcgccguguucaccgaggagaaccagugggacagcgccaaggccgccguggaggacgaggaguucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcuggugagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17895 - RNA, 9873 nt, Artificial Sequence
  derived and/or modified CDS sequence (opt4) from DENV-3__GQ199886__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaugggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaccaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagaaggacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17896 - RNA, 9873 nt, Artificial Sequence
  derived and/or modified CDS sequence (opt4) from DENV-3__FJ882576__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcauggccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacgugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcuggccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggcgagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucgugagcagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17897 - RNA, 9873 nt, Artificial Sequence
  derived and/or modified CDS sequence (opt4) from DENV-3__FJ850052__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucggccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacaaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17898 - RNA, 9873 nt, Artificial Sequence
  derived and/or modified CDS sequence (opt4) from DENV-3__FJ873812__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucagcaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguuccugaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17899 - RNA, 9873 nt, Artificial Sequence
  derived and/or modified CDS sequence (opt4) from DENV-3__FJ873813__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcagcacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagauacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17900 - RNA, 9873 nt, Artificial Sequence
  derived and/or modified CDS sequence (opt4) from DENV-3__FJ850048__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17901 - RNA, 9873 nt, Artificial Sequence
  derived and/or modified CDS sequence (opt4) from DENV-3__FJ850049__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcagcacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccaugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccaacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17902 - RNA, 9873 nt, Artificial Sequence
  derived and/or modified CDS sequence (opt4) from DENV-3__FJ898476__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucggccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17903 - RNA, 9873 nt, Artificial Sequence
  derived and/or modified CDS sequence (opt4) from DENV-3__FJ898475__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguuccugaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17904 - RNA, 9873 nt, Artificial Sequence
  derived and/or modified CDS sequence (opt4) from DENV-3__GQ199861__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcagcacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccaugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccaacgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17905 - RNA, 9873 nt, Artificial Sequence
  derived and/or modified CDS sequence (opt4) from DENV-3__GQ199862__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcauccugggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccgugaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17906 - RNA, 9873 nt, Artificial Sequence
  derived and/or modified CDS sequence (opt4) from DENV-3__GQ199863__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggugauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaucuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17907 - RNA, 9873 nt, Artificial Sequence
  derived and/or modified CDS sequence (opt4) from DENV-3__GQ199864__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccugaacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcagcacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaucggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17908 - RNA, 9873 nt, Artificial Sequence
  derived and/or modified CDS sequence (opt4) from DENV-3__GQ199865__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcagcacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccaugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccuggggcgaggaggccgagcagaccggcgugagccacaugcugaugaucaccguggaggacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17909 - RNA, 9873 nt, Artificial Sequence
  derived and/or modified CDS sequence (opt4) from DENV-3__GQ199870__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucggccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagaugagcuggaucagcaacggcaccggcaacaucguggccagcgugaacauggugagcagacugcugcugaacagaagcaccaugacccacagaagacccaccaucgagaaggacguggaccugggcgccggccccagacacgugaacgccgaccccgagccccccaacauggacgugaucggcgagagaaucaagagagugaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugccccagauggccaugaccgacaccacccccuucggccagcagagaguguucaaggagaagguggacaccagaacccccagaagcauccccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17910 - RNA, 9873 nt, Artificial Sequence
  derived and/or modified CDS sequence (opt4) from DENV-3__JF937630__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacgccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17911 - RNA, 9873 nt, Artificial Sequence
  derived and/or modified CDS sequence (opt4) from DENV-3__JN000936__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgugguguucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaucuaccagcuguggaccgcccugaucagccugaccugcagcaacaccaucuucacccugaccguggccuggagaaccgccacccugauccuggccggcgugagccugcugcccaugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucaccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgacgacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17912 - RNA, 9873 nt, Artificial Sequence
  derived and/or modified CDS sequence (opt4) from DENV-3__HQ541796__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaccgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucggccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugaccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17913 - RNA, 9873 nt, Artificial Sequence
  derived and/or modified CDS sequence (opt4) from DENV-3__HQ166034__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcagcacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaucuaccagcuguggaccgcccugaucagccugaccugcagcaacaccaucuucacccugaccguggccuggagaaccgccacccugauccuggccggcgugagccugcugcccaugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcguggugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcgccgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17914 - RNA, 9873 nt, Artificial Sequence
  derived and/or modified CDS sequence (opt4) from DENV-3__HM756274__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacgccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucggccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17915 - RNA, 9873 nt, Artificial Sequence
  derived and/or modified CDS sequence (opt4) from DENV-3__HM756275__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcagcacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaucuaccagcuguggaccgcccugaucagccugaccugcagcaacaccaucuucacccugaccguggccuggagaaccgccacccugauccuggccggcgugagccugcugcccaugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcguggugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17916 - RNA, 9873 nt, Artificial Sequence
  derived and/or modified CDS sequence (opt4) from DENV-3__JF937632__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaucggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagagagccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcccccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacagacugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17917 - RNA, 9873 nt, Artificial Sequence
  derived and/or modified CDS sequence (opt4) from DENV-3__HM756281__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcguggugaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccaaggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucagagagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17918 - RNA, 9873 nt, Artificial Sequence
  derived and/or modified CDS sequence (opt4) from DENV-3__JF937643__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagaaggccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucgcccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucgccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccgugaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgacgacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17919 - RNA, 9873 nt, Artificial Sequence
  derived and/or modified CDS sequence (opt4) from DENV-3__HM181972__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggugcugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccuggggcaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17920 - RNA, 9873 nt, Artificial Sequence
  derived and/or modified CDS sequence (opt4) from DENV-3__HM631857__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacaccgcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucggccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucgccgaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccgugaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacguggagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17921 - RNA, 9873 nt, Artificial Sequence
  derived and/or modified CDS sequence (opt4) from DENV-3__HM631860__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcguggugaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccaaggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccuacuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17922 - RNA, 9873 nt, Artificial Sequence
  derived and/or modified CDS sequence (opt4) from DENV-3__HM181977__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcguggugaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccaaggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17923 - RNA, 9873 nt, Artificial Sequence
  derived and/or modified CDS sequence (opt4) from DENV-3__HM181978__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcagcgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucggccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17924 - RNA, 9873 nt, Artificial Sequence
  derived and/or modified CDS sequence (opt4) from DENV-3__JN183884__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaagaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucggccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17925 - RNA, 9873 nt, Artificial Sequence
  derived and/or modified CDS sequence (opt4) from DENV-3__HQ541785__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucgccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucaccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgacgacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17926 - RNA, 9873 nt, Artificial Sequence
  derived and/or modified CDS sequence (opt4) from DENV-3__HM181975__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucgugcugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcagcacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaucuaccagcuguggaccgcccugaucagccugaccugcagcaacaccaucuucacccugaccguggccuggagaaccgccacccugauccuggccggcgugagccugcugcccaugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcguggugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugauccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17927 - RNA, 9873 nt, Artificial Sequence
  derived and/or modified CDS sequence (opt4) from DENV-3__HM631864__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagaaggccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacagcaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucgccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccgugaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgacgacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17928 - RNA, 9873 nt, Artificial Sequence
  derived and/or modified CDS sequence (opt4) from DENV-3__HM631859__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcagcacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaucuaccagcuguggaccgcccugaucagccugaccugcagcaacaccaucuucacccugaccguggccuggagaaccgccacccugauccuggccggcgugagccugcugcccaugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcguggugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggagacugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17929 - RNA, 9870 nt, Artificial Sequence
  derived and/or modified CDS sequence (opt4) from DENV-3__HM631856__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcguggugaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccaaggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucagaaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17930 - RNA, 9873 nt, Artificial Sequence
  derived and/or modified CDS sequence (opt4) from DENV-3__HM756276__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcguggugaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17931 - RNA, 9873 nt, Artificial Sequence
  derived and/or modified CDS sequence (opt4) from DENV-3__HM756279__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaccgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucggccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaacuucugggagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugaccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17932 - RNA, 9873 nt, Artificial Sequence
  derived and/or modified CDS sequence (opt4) from DENV-3__HQ891025__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucggccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugaugaacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17933 - RNA, 9873 nt, Artificial Sequence
  derived and/or modified CDS sequence (opt4) from DENV-3__HQ705617__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucagaauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucggccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17934 - RNA, 9873 nt, Artificial Sequence
  derived and/or modified CDS sequence (opt4) from DENV-3__HQ705619__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccugaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucggccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17935 - RNA, 9873 nt, Artificial Sequence
  derived and/or modified CDS sequence (opt4) from DENV-3__HQ705620__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcagcacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccugggugggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaagacugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagagaaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17936 - RNA, 9873 nt, Artificial Sequence
  derived and/or modified CDS sequence (opt4) from DENV-3__HQ705621__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcagcacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaucuaccagcuguggaccgcccugaucagccugaccugcagcaacaccaucuucacccugaccguggccuggagaaccgccacccugauccuggccggcgugagccugcugcccaugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcguggugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcaccacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17937 - RNA, 9873 nt, Artificial Sequence
  derived and/or modified CDS sequence (opt4) from DENV-3__HQ671176__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcagcacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaucuaccagcuguggaccgcccugaucagccugaccugcagcaacaccaucuucacccugaccguggccuggagaaccgccacccugauccuggccggcgugagccugcugcccaugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucgugauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17938 - RNA, 9873 nt, Artificial Sequence
  derived and/or modified CDS sequence (opt4) from DENV-3__HQ705609__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcguggugaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccaaggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaucguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucagagagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17939 - RNA, 9873 nt, Artificial Sequence
  derived and/or modified CDS sequence (opt4) from DENV-3__HQ705610__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacaccaucuggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguuccugaccuucgugcugcugcugagcggccagaucaccuggaaggacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucagcacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcguggugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17940 - RNA, 9873 nt, Artificial Sequence
  derived and/or modified CDS sequence (opt4) from DENV-3__HQ705611__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucggccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagaagaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17941 - RNA, 9873 nt, Artificial Sequence
  derived and/or modified CDS sequence (opt4) from DENV-3__HQ705612__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucggccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaccaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugacccacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17942 - RNA, 9873 nt, Artificial Sequence
  derived and/or modified CDS sequence (opt4) from DENV-3__HQ705613__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucggccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuaccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaccagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17943 - RNA, 9873 nt, Artificial Sequence
  derived and/or modified CDS sequence (opt4) from DENV-3__HQ705615__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucgccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucaccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuaccacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgacgacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17944 - RNA, 9873 nt, Artificial Sequence
  derived and/or modified CDS sequence (opt4) from DENV-3__JF920398__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacaccaucuggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguuccugaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17945 - RNA, 9873 nt, Artificial Sequence
  derived and/or modified CDS sequence (opt4) from DENV-3__JF920402__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcagcacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcgccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaucuaccagcuguggaccgcccugaucagccugaccugcagcaacaccaucuucacccugaccguggccuggagaaccgccacccugauccuggccggcgugagccugcugcccaugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcguggugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17946 - RNA, 9873 nt, Artificial Sequence
  derived and/or modified CDS sequence (opt4) from DENV-3__JF937652__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacaacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccgugcugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcuggugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaacuacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaagcugggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucggccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagaaggacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacaugggcgcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17947 - RNA, 9873 nt, Artificial Sequence
  derived and/or modified CDS sequence (opt4) from DENV-3__JF920404__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacgccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucggccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggagggcgccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17948 - RNA, 9873 nt, Artificial Sequence
  derived and/or modified CDS sequence (opt4) from DENV-3__JF937641__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacgccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucggccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17949 - RNA, 9873 nt, Artificial Sequence
  derived and/or modified CDS sequence (opt4) from DENV-3__JF920396__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgcccugcugaccuggaucggccugaacagcaagaacaccagcaugagcuucagcugcaucgccaucggcaucaucacccuguaccugggcgccguggugcaggccgacaugggcugcguggugaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17950 - RNA, 9873 nt, Artificial Sequence
  derived and/or modified CDS sequence (opt4) from DENV-3__JF920406__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacgccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucgagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucggccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17951 - RNA, 9873 nt, Artificial Sequence
  derived and/or modified CDS sequence (opt4) from DENV-3__JF920409__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccuggcccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcgccuucuucauguucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagagcgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17952 - RNA, 9873 nt, Artificial Sequence
  derived and/or modified CDS sequence (opt4) from DENV-3__JF920408__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacggcacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccggcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucggccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggaggugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccgacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17953 - RNA, 9873 nt, Artificial Sequence
  derived and/or modified CDS sequence (opt4) from DENV-3__JF920397__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcagcacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggaccugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaucuaccagcuguggaccgcccugaucagccugaccugcagcaacaccaucuucacccugaccguggccuggagaaccgccacccugauccuggccggcgugagccugcugcccaugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcacccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcguggugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17954 - RNA, 9873 nt, Artificial Sequence
  derived and/or modified CDS sequence (opt4) from DENV-3__JN093513__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcagcacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacaccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaucuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucggccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17955 - RNA, 9873 nt, Artificial Sequence
  derived and/or modified CDS sequence (opt4) from DENV-3__JF937624__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucggccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaucaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagaaucaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17956 - RNA, 9873 nt, Artificial Sequence
  derived and/or modified CDS sequence (opt4) from DENV-3__JN000938__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccuucagcgagaaggaggagaacauggugaagagccuggugagcgccggcggcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucggccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17957 - RNA, 9873 nt, Artificial Sequence
  derived and/or modified CDS sequence (opt4) from DENV-3__JN093515__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcagcacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagagagaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaucuaccagcuguggaccgcccugaucagccugaccugcagcaacaccaucuucacccugaccguggccuggagaaccgccacccugauccuggccggcgugagccugcugcccaugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcguggugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacaucaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcuggugaacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17958 - RNA, 9873 nt, Artificial Sequence
  derived and/or modified CDS sequence (opt4) from DENV-3__JF937646__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcaucggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacgccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggugaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucggccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggugggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17959 - RNA, 9873 nt, Artificial Sequence
  derived and/or modified CDS sequence (opt4) from DENV-3__JF937633__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucggccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucacccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17960 - RNA, 9873 nt, Artificial Sequence
  derived and/or modified CDS sequence (opt4) from DENV-3__JF937634__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgugaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucggccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggaggugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccgacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17961 - RNA, 9873 nt, Artificial Sequence
  derived and/or modified CDS sequence (opt4) from DENV-3__JF937636__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcauccugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucagaagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17962 - RNA, 9873 nt, Artificial Sequence
  derived and/or modified CDS sequence (opt4) from DENV-3__JF937626__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucggccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacaugguggugcccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17963 - RNA, 9873 nt, Artificial Sequence
  derived and/or modified CDS sequence (opt4) from DENV-3__JF937621__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucggccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagagagccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17964 - RNA, 9873 nt, Artificial Sequence
  derived and/or modified CDS sequence (opt4) from DENV-3__JF937623__SS-prME
gccagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcaucuucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucggccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaugaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcaucuacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17965 - RNA, 9873 nt, Artificial Sequence
  derived and/or modified CDS sequence (opt4) from DENV-3__JF937637__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacgccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucggccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugcugaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17966 - RNA, 9873 nt, Artificial Sequence
  derived and/or modified CDS sequence (opt4) from DENV-3__JF937638__SS-prME
accagccugugccugcugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaagacugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugcagaagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagagaaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugacccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaaccugaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagaucaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17967 - RNA, 9873 nt, Artificial Sequence
  derived and/or modified CDS sequence (opt4) from DENV-3__JF937639__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcagaaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagaggccuacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacaccaucuggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguuccugaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagaccaagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17968 - RNA, 9873 nt, Artificial Sequence
  derived and/or modified CDS sequence (opt4) from DENV-3__JF937627__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcagcacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagagagaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaucuaccagcuguggaccgcccugaucagccugaccugcagcaacaccaucuucacccugaccguggccuggagaaccgccacccugauccuggccggcgugagccugcugcccaugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcguggugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacaucaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcuggugaacaaggagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17969 - RNA, 9873 nt, Artificial Sequence
  derived and/or modified CDS sequence (opt4) from DENV-3__KF973476__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaucggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaagacugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagaggcggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaccagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccguggacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagagaaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaaccccuaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17970 - RNA, 9873 nt, Artificial Sequence
  derived and/or modified CDS sequence (opt4) from DENV-3__KF973478__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcagcacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccagccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucggccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacagacugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17971 - RNA, 9873 nt, Artificial Sequence
  derived and/or modified CDS sequence (opt4) from DENV-3__KF973479__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaaccugggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcagcgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucggccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17972 - RNA, 9873 nt, Artificial Sequence
  derived and/or modified CDS sequence (opt4) from DENV-3__KF973480__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucacccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagaucuucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgcccugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucggccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17973 - RNA, 9873 nt, Artificial Sequence
  derived and/or modified CDS sequence (opt4) from DENV-3__KF973481__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccaucaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccgugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucggccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17974 - RNA, 9873 nt, Artificial Sequence
  derived and/or modified CDS sequence (opt4) from DENV-3__KF973482__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccaucaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccgugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucggccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaccaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17975 - RNA, 9873 nt, Artificial Sequence
  derived and/or modified CDS sequence (opt4) from DENV-3__KF973483__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcagaaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgugggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagaccuacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacaccaucuggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguuccugaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17976 - RNA, 9873 nt, Artificial Sequence
  derived and/or modified CDS sequence (opt4) from DENV-3__KF973485__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacaagaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagaggugcacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucggccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggaagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccguggccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcguggugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggaggugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacauggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccgacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17977 - RNA, 9873 nt, Artificial Sequence
  derived and/or modified CDS sequence (opt4) from DENV-3__KF973486__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccacccugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccagggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgugagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucggccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggaguucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgccccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggacuucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugaaggagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17978 - RNA, 9873 nt, Artificial Sequence
  derived and/or modified CDS sequence (opt4) from DENV-3__FJ898458__SS-prME
accagccugugccugaugaugauccugcccgccgcccuggccuuccaccugaccagcagagacggcgagcccagaaugaucgugggcaagaacgagagaggcaagacccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccacggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccaugaccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggaagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17979 - RNA, 9873 nt, Artificial Sequence
  derived and/or modified CDS sequence (opt4) from DENV-3__KJ189256__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccacggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17980 - RNA, 9873 nt, Artificial Sequence
  derived and/or modified CDS sequence (opt4) from DENV-3__KJ189257__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccacggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacaccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccguguuccugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17981 - RNA, 9873 nt, Artificial Sequence
  derived and/or modified CDS sequence (opt4) from DENV-3__KJ189262__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccacggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccaucgagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17982 - RNA, 9873 nt, Artificial Sequence
  derived and/or modified CDS sequence (opt4) from DENV-3__KJ189263__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccacccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccgugcugaucaagguggaguacaagggcgaggacgugcccugcaagauccccuucagcaccgaggacggccacggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugagacugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaucuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcacccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17983 - RNA, 9873 nt, Artificial Sequence
  derived and/or modified CDS sequence (opt4) from DENV-3__KJ189265__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccacggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcacggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacaccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccaacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17984 - RNA, 9873 nt, Artificial Sequence
  derived and/or modified CDS sequence (opt4) from DENV-3__KJ189266__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccauccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgugcccugcaagauccccuucagcaccgaggacggccacggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugaagcugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcgcccaguggcagaagggcgaggaggugcaggugaucgccaucgagcccggcaagaaccccaagaacuuccaggccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggagaacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17985 - RNA, 9873 nt, Artificial Sequence
  derived and/or modified CDS sequence (opt4) from DENV-3__KJ189268__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccacccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccacggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugagacugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcacccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccaagaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaccaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17986 - RNA, 9873 nt, Artificial Sequence
  derived and/or modified CDS sequence (opt4) from DENV-3__KJ189271__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccacccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccacggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugagacugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaagcugggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcacccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17987 - RNA, 9873 nt, Artificial Sequence
  derived and/or modified CDS sequence (opt4) from DENV-3__KJ189272__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugccccuacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccacccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccacggcaaggcccacaacggcagacugaucaccgccaaccccguggugaccaagaaggaggagcccgugagcaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugagacugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcacccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17988 - RNA, 9873 nt, Artificial Sequence
  derived and/or modified CDS sequence (opt4) from DENV-3__KJ189273__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggugacccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccacggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugagacugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaucuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcacccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17989 - RNA, 9873 nt, Artificial Sequence
  derived and/or modified CDS sequence (opt4) from DENV-3__KJ189274__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccacccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccacggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcagaagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugagacugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaucuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcacccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucagagaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17990 - RNA, 9873 nt, Artificial Sequence
  derived and/or modified CDS sequence (opt4) from DENV-3__KJ189275__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccacccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccacggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcagaagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugagacugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcacccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucagagaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17991 - RNA, 9873 nt, Artificial Sequence
  derived and/or modified CDS sequence (opt4) from DENV-3__KJ189276__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccacccugcccgaguacggcacccugggccugcagugcagccccagaaccggccuggacuucaacgagaugauccugcugaccaugaagaacaaggccuggauggugcacagacagugguucuucgaccugccccugcccuggaccagcggcgccaccagcgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccacggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugagacugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcacccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccaguggaacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagaagacuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17992 - RNA, 9873 nt, Artificial Sequence
  derived and/or modified CDS sequence (opt4) from DENV-3__KJ189277__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaucaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccacccugcccgaguacggcacccugggccugcagugcagccccagaaccggccuggacuucaacgagaugauccugcugaccaugaagaacaaggccuggauggugcacagacagugguucuucgaccugccccugcccuggaccagcggcgccaccagcgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccacggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacaucaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugagacugagagaggccuacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcacccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccaguggaacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagaagacuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga

SEQ ID NO: 17993 - RNA, 9873 nt, Artificial Sequence
  derived and/or modified CDS sequence (opt4) from DENV-3__KJ189278__SS-prME
accagccugugccugaugaugauccugcccgccgcccuggccuuccaccugaccagcagagacggcgagcccagaaugaucgugggcaagaacgagagaggcaagagccugcuguucaagaccgccagcggcaccaacaugugcacccugaucgccauggaccugggcgagaugugcgacgacaccgugaccuacaagugcccccacaucaccgagguggagcccgaggacaucgacugcuggugcaaccugaccagcaccugggugaccuacggcaccugcaaccaggccggcgagcacagaagagacaagagaagcguggcccuggccccccacgugggcaugggccuggacaccagaacccagaccuggaugagcgccgagggcgccuggagacagguggagaagguggagaccugggcccugagacaccccggcuucaccauccuggcccuguuccuggcccacuacaucggcaccagccugacccagaagguggugaucuucauccugcugaugcuggugacccccagcaugaccaugagaugcgugggcgugggcaacagagacuucguggagggccugagcggcgccaccuggguggacguggugcuggagcacggcggcugcgugaccaccauggccaagaacaagcccacccuggacaucgagcugcagaagaccgaggccacccagcuggccacccugagaaagcugugcaucgagggcaagaucaccaacaucaccaccgacagcagaugccccacccagggcgaggccgugcugcccgaggagcaggaccagaacuacgugugcaagcacaccuacguggacagaggcuggggcaacggcugcggccuguucggcaagggcagccuggugaccugcgccaaguuccagugccuggagcccaucgagggcaagguggugcaguacgagaaccugaaguacaccgugaucaucaccgugcacaccggcgaccagcaccaggugggcaacgagacccagggcgugaccgccgagaucaccccccaggccagcaccaccgaggccacccugcccgaguacggcacccugggccuggagugcagccccagaaccggccuggacuucaacgagaugauccugcugaccaugaagaacaaggccuggauggugcacagacagugguucuucgaccugccccugcccuggaccagcggcgccaccaccgagacccccaccuggaacagaaaggagcugcuggugaccuucaagaacgcccacgccaagaagcaggaggugguggugcugggcagccaggagggcgccaugcacaccgcccugaccggcgccaccgagauccagaacagcggcggcaccagcaucuucgccggccaccugaagugcagacugaagauggacaagcuggagcugaagggcaugagcuacgccaugugcaccaacaccuucgugcugaagaaggaggugagcgagacccagcacggcaccauccugaucaagguggaguacaagggcgaggacgcccccugcaagauccccuucagcaccgaggacggccacggcaaggcccacaacggcagacugaucaccgccaaccccguggugaccaagaaggaggagcccgugaacaucgaggccgagccccccuucggcgagagcaacaucgugaucggcaucggcgacaacgcccugaagaucaacugguacaagaagggcagcagcaucggcaagauguucgaggccaccgccagaggcgccagaagaauggccauccugggcgacaccgccugggacuucggcagcgugggcggcgugcugaacagccugggcaagauggugcaccagaucuucggcagcgccuacaccgcccuguucagcggcgugagcugggugaugaagaucggcaucggcgugcugcugaccuggaucggccugaacagcaagaacaccagcaugagcuucagcugcaucgccaucggcaucaucacccuguaccugggcgccguggugcaggccgacaugggcugcgugaucaacuggaagggcaaggagcugaagugcggcagcggcaucuucgugaccaacgaggugcacaccuggaccgagcaguacaaguuccaggccgacagccccaagagacuggccaccgccaucgccggcgccugggagaacggcgugugcggcaucagaagcaccaccagaauggagaaccugcuguggaagcagaucgccaacgagcugaacuacauccugugggagaacaacgugaagcugaccgugguggugggcgacaucaucggcgugcuggagcagggcaagagaacccugaccccccagcccauggagcugaaguacagcuggaagaccuggggcaaggccaagaucgugaccgccgagacccagaacagcagcuucaucaucgacggccccaacacccccgagugccccagcgccagcagagccuggaacgugugggagguggaggacuacggcuucggcguguucaccaccaacaucuggcugagacugagagagguguacacccagcugugcgaccacagacugaugagcgccgccgugaaggacgagagagccgugcacgccgacaugggcuacuggaucgagagccagaagaacggcagcuggaagcuggagaaggccagccugaucgaggugaagaccugcaccuggcccaagagccacacccuguggagcaacggcgugcuggagagcgacaugaucauccccaagagccuggccggccccaucagccagcacaaccacagacccggcuaccacacccagaccgccggccccuggcaccugggcaagcuggagcuggacuucaacuacugcgagggcaccaccguggugaucaccgagaacugcggcaccagaggccccagccugagaaccaccaccgugagcggcaagcugauccacgaguggugcugcagaagcugcacccugcccccccugagauacaugggcgaggacggcugcugguacggcauggagaucagacccaucagcgagaaggaggagaacauggugaagagccuggugagcgccggcagcggcaagguggacaacuucaccaugggcgugcugugccuggccauccuguucgaggaggugaugagaggcaaguucggcaagaagcacaugaucgccggcguguucuucaccuucgugcugcugcugagcggccagaucaccuggagagacauggcccacacccugaucaugaucggcagcaacgccagcgacagaaugggcaugggcgugaccuaccuggcccugaucgccaccuucaagauccagcccuuccuggcccugggcuucuuccugagaaagcugaccagcagagagaaccugcugcugggcgugggccuggccauggccaccacccugcagcugcccgaggacaucgagcagauggccaacggcaucgcccugggccugauggcccugaagcugaucacccaguucgagaccuaccagcuguggaccgcccugaucagccugaccugcagcaacaccaucuucacccugaccguggccuggagaaccgccacccugauccuggccggcgugagccugcugcccgugugccagagcagcagcaugagaaagaccgacuggcugcccauggccguggccgccaugggcgugcccccccugccccuguucaucuucagccugaaggacacccugaagagaagaagcuggccccugaacgagggcgugauggccgugggccuggugagcauccuggccagcagccugcugagaaacgacgugcccauggccggcccccugguggccggcggccugcugaucgccugcuacgugaucaccggcaccagcgccgaccugaccguggagaaggccgccgacaucaccugggaggaggaggccgagcagaccggcgugagccacaaccugaugaucaccguggacgacgacggcaccaugagaaucaaggacgacgagaccgagaacauccugaccgugcugcugaagaccgcccugcugaucgugagcggcaucuuccccuacagcauccccgccacccugcugguguggcacaccuggcagaagcagacccagagaagcggcgugcugugggacgugcccagcccccccgagacccagaaggccgagcuggaggagggcguguacagaaucaagcagcagggcaucuucggcaagacccaggugggcgugggcgugcagaaggagggcguguuccacaccauguggcacgugaccagaggcgccgugcugaccuacaacggcaagagacuggagcccaacugggccagcgugaagaaggaccugaucagcuacggcggcggcuggagacugagcacccaguggcagaagggcgaggaggugcaggugaucgccguggagcccggcaagaaccccaagaacuuccagaccaugcccggcaccuuccagaccaccaccggcgagaucggcgccaucgcccuggacuucaagcccggcaccagcggcagccccaucaucaacagagagggcaagguggugggccuguacggcaacggcguggugaccaagaacggcggcuacgugagcggcaucgcccagaccaacgccgagcccgacggccccacccccgagcuggaggaggagauguucaagaagagaaaccugaccaucauggaccugcaccccggcagcggcaagaccagaaaguaccugcccgccaucgugagagaggccaucaagagaagacugagaacccugauccuggcccccaccagagugguggccgccgagauggaggaggcccugaagggccugcccaucagauaccagaccaccgccaccaagagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagagugggcaugggcgaggccgccgccaucuucaugaccgccaccccccccggcaccgccgacgccuucccccagagcaacgcccccauccaggacgaggagagagacauccccgagagaagcuggaacagcggcaacgaguggaucaccgacuucgccggcaagaccgugugguucgugcccagcaucaaggccggcaacgacaucgccaacugccugagaaagaacggcaagaaggugauccagcugagcagaaagaccuucgacaccgaguaccagaagaccaagcugaacgacugggacuucguggugaccaccgacaucagcgagaugggcgccaacuucaaggccgacagagugaucgaccccagaagaugccugaagcccgugauccugaccgacggccccgagagagugauccuggccggccccaugcccgugaccgccgccagcgccgcccagagaagaggcagagugggcagaaacccccagaaggagaacgaccaguacaucuucaccggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugaagggcgagagcagaaagaccuucguggagcugaugagaagaggcgaccugcccguguggcuggcccacaagguggccagcgagggcaucaaguacaccgacagaaaguggugcuucgacggccagagaaacaaccagauccuggaggagaacauggacguggagaucuggaccaaggagggcgagaagaagaagcugagacccagauggcuggacgccagaaccuacagcgacccccuggcccugaaggaguucaaggacuucgccgccggcagaaagagcaucgcccuggaccuggugaccgagaucggcagagugcccagccaccuggcccacagaaccagaaacgcccuggacaaccuggugaugcugcacaccagcgagcacggcggcagagccuacagacacgccguggaggagcugcccgagaccauggagacccugcugcugcugggccugaugauccugcugaccggcggcgccaugcuguuccugaucagcggcaagggcaucggcaagaccagcaucggccugaucugcgugaucgccagcagcggcaugcuguggauggccgagaucccccugcaguggaucgccagcgccaucgugcuggaguucuucaugauggugcugcugauccccgagcccgagaagcagagaaccccccaggacaaccagcuggccuacguggugaucggcauccugacccuggccgccaucaucgccgccaacgagaugggccugcuggagaccaccaagagagaccugggcaugagcaaggagcccggcguggugagccccaccagcuaccuggacguggaccugcaccccgccagcgccuggacccuguacgccguggccaccaccgugaucacccccaugcugagacacaccaucgagaacagcaccgccaacgugagccuggccgccaucgccaaccaggccguggugcugaugggccuggacaagggcuggcccaucagcaagauggaccugggcgugccccugcuggcccugggcugcuacagccaggugaacccccugacccugaccgccgccgugcugcugcugaucacccacuacgccaucaucggccccggccugcaggccaaggccaccagagaggcccagaagagaaccgccgccggcaucaugaagaaccccaccguggacggcaucaugaccaucgaccuggaccccgugaucuacgacagcaaguucgagaagcagcugggccaggugaugcugcuggugcugugcgccgugcagcugcugcugaugagaaccagcugggcccugugcgaggcccugacccuggccaccggccccaucaccacccugugggagggcagccccggcaaguucuggaacaccaccaucgccgugagcauggccaacaucuucagaggcagcuaccuggccggcgccggccuggccuucagcaucaugaagagcgugggcaccggcaagagaggcaccggcagccagggcgagacccugggcgagaaguggaagaagaagcugaaccagcugagcagaaaggaguucgaccuguacaagaagagcggcaucaccgagguggacagaaccgaggccaaggagggccugaagagaggcgagaucacccaccacgccgugagcagaggcagcgccaagcugcagugguucguggagagaaacauggugauccccgagggcagagugaucgaccugggcugcggcagaggcggcuggagcuacuacugcgccggccugaagaaggugaccgaggugagaggcuacaccaagggcggccccggccacgaggagcccgugcccaugagcaccuacggcuggaacaucgugaagcugaugagcggcaaggacguguucuaccugccccccgagaagugcgacacccugcugugcgacaucggcgagagcagccccagccccaccguggaggagagcagaaccaucagagugcugaagaugguggagcccuggcugaagaacaaccaguucugcaucaaggugcugaaccccuacaugcccaccgugaucgagcaccuggagagacugcagagaaagcacggcggcaugcuggugagaaacccccugagcagaaacagcacccacgagauguacuggaucagcaacggcaccggcaacaucguggccagcgugaacauggugagcagacugcugcugaacagauucaccaugacccacagaagacccaccaucgagaaggacguggaccugggcgccggcaccagacacgugaacgccgagcccgagacccccaacauggacgugaucggcgagagaaucaagagaaucaaggaggagcacaacagcaccuggcacuacgacgacgagaaccccuacaagaccugggccuaccacggcagcuacgaggugaaggccaccggcagcgccagcagcaugaucaacggcguggugaagcugcugaccaagcccugggacguggugcccauggugacccagauggccaugaccgacaccacccccuucggccagcagagaguguucaaggagaagguggacaccagaacccccagaagcaugcccggcaccagaagagugaugggcaucaccgccgaguggcuguggagaacccugggcagaaacaagaagcccagacugugcaccagagaggaguucaccaagaaggugagaaccaacgccgccaugggcgccguguucaccgaggagaaccagugggacagcgccaaggccgccguggaggacgaggacuucuggaagcugguggacagagagagagagcugcacaagcugggcaagugcggcagcugcguguacaacaugaugggcaagagagagaagaagcugggcgaguucggcaaggccaagggcagcagagccaucugguacauguggcugggcgccagauaccuggaguucgaggcccugggcuuccugaacgaggaccacugguucagcagagagaacagcuacagcggcguggagggcgagggccugcacaagcugggcuacauccugagagacaucagcaagauccccggcggcgccauguacgccgacgacaccgccggcugggacaccagaaucaccgaggacgaccugcacaacgaggagaagaucacccagcagauggaccccgagcacagacagcuggccaacgccaucuucaagcugaccuaccagaacaagguggugaaggugcagagacccacccccaccggcaccgugauggacaucaucagcagaaaggaccagagaggcagcggccaggugggcaccuacggccugaacaccuucaccaacauggaggcccagcugaucagacagauggagggcgagggcgugcugagcaaggccgaccuggagaacccccaccugcccgagaagaagaucacccaguggcuggagaccaagggcguggagagacugaagagaauggccaucagcggcgacgacugcguggugaagcccaucgacgacagauucgccaacgcccugcuggcccugaacgacaugggcaaggugagaaaggacaucccccaguggcagcccagcaagggcuggcacgacuggcagcaggugcccuucugcagccaccacuuccacgagcugaucaugaaggacggcagaaagcugguggugcccugcagaccccaggacgagcugaucggcagagccagaaucagccagggcgccggcuggagccugagagagaccgccugccugggcaaggccuacgcccagauguggagccugauguacuuccacagaagagaccugagacuggccagcaacgccaucugcagcgccgugcccgugcacugggugcccaccagcagaaccaccuggagcauccacgcccaccaccaguggaugaccaccgaggacaugcugaccguguggaacagaguguggaucgaggacaaccccuggauggaggacaagacccccgugaccaccugggaggacgugcccuaccugggcaagagagaggaccaguggugcggcagccugaucggccugaccagcagagccaccugggcccagaacauccccaccgccauccagcaggugagaagccugaucggcaacgaggaguuccuggacuacaugcccagcaugaagagauucagaaaggaggaggagagcgagggcgccaucugguga
